United States Patent 8,781,750 (CELL-TYPE-SPECIFIC PATTERNS OF GENE EXPRESSION) - sequence listing, part 62

SEQ ID NO: 38821 - DNA, 27117 bp, Homo sapiens
gtgcagcttggtggcggctgagccggcagcgggccgcctcaggcagccccggccgggccgcccgggtccccggcagcggggtaggatggcgctaaagcggatccagaaggtacgcactttcccaccctccaactctttgggtgtccgaagcgtcgaggtgtgggcggggcgccgctgccgtgaagtgaaaggtgacggaggctccgcgagtcgcggatacacctgcctgggaaggaggcagaacagcctcccgcgcagcctgaaaagcgaacgcagcctgagaaagggattgcgcgagcgcggggcggggccgggccgtggccacgagggctgcgtcatgcgggcggggcgccgtggggccacctgcaggcttctggacagcgggttccccctgtagggtatccagaagggctgggtgggtatccagaagggtatccaggaagaagctgggtcctaagggatgagtaggaactcggcaggtggggaaaaggggaaaaggctttccctgcaacggggagactacgaggcttggaggactgacagggtagcggggaagctgaagggcagatggtgtggacttgggtggtccttaggagcagtgctgaagtaactggtttttatcctgcaggtaagagggagtccatgagggtttaatgcattcactagaatttggaaaacgcacaacagtagaagaaagaagtatttctaattctatcactttactatttgttaacattttagcatacctaccttcagttttttttctatatttaaaacaattatactgcattttgtattccacttattcacataatagtaaatgtaagcatgttgtgaagtagtatttataactttttttttttttttttttgaggtcttgctctgtcgcccaggctggagtatcgcccaggctggagtacagtggcacaatcatggctcactgcagcctcaaccttctaggttcaagtgatcctccctcctcagcttcctgggtagctgggactacatgccaccatgccagccaattgtttattttttgtagagacagtgtctcgatatgttgcccaggctggtctcatactcctgggcttaagcggtcctcttgcctctgcctcctaaagtggcgggattacaacgtgagacaccatgcccagtcctataactaatttttaacattaactttccacaagtacatgactagtaacttatttagtcattacctgtagtaggtaaaagtatggacttgggtgtcagacagacctgggttagagaatgtgaggtcacttatagtgggaccttgggcaaggcactttatcattcctagcctcccagtcctacatgtttacagagttgttttgagaattaaatgctatgaaatgtgtttagcacatgcttgctgtataccaaacactcaatacgagttagctgctgttattgttcaaaattcttcactaagtatttgctgttacgaactgtgtattagtctgttttgtgttgctataaaggaatatctgaggctgggtaattaataaagaaaagaggtttatttggctctcggttctgcaggctgtacaagaagcatggtgccagcatctgcttctggtgaggcctcaggaagcttacaatcatggcagaaagcaaaggagaagcaggcgtgtcacctggtaagagagggagcaagagagatgccacctcttttaaacacccagatctcacatgaactaatagagtgagcactcacttattattgtgggggggccaccaagccattcatgaggaatccgcccccacgacccagatacctcccactaggccccacctccaacactggcgatcacatttcagcatgagatttgggggggacaaatatccaaaccagatcaaccatcattgtacaatgagccttttccttaattcacattactgggtttgattgccagaggtggaattacaggatctctgagagtatgactcttttttttttttttaaataaatagctgtccaaaagagagataattctgatgagttattctctgaaaggggtcatctgtcatcctaggactttgaagcaggtgaatgacatgctgagatctgtgttctaaaaagatctttctggcagcagtgtggccggaagtgggacagagggagactagaggctgttgtgaaggttcagtagaggctttgtccaaattaatgaccatggaatggatgctaggccagagcagtgcctggaccacattgcagaagtggaattgacaggactcgaggagaggatgtggtgaaagtgaaacaaggaggtgtacaaaatgggtcacttagtggatggtggtgtcagtgtctaggatggggaatcagaagttttgaaggcagggaggagggtaggagagattaaggaataaaggtttgagcctacatattcaaatgtgtaggctgataagatttataaaagggagcgtttggaaaaacaagtttgggccttgagcatgaaatgtcaactatagatccaaggtaattgaaatcataaggccagggagaacttttccttgataagaatcaaggacaggctgggtacagtggctcatgcctatatcccagcactctgggaggccgaggcaggtggattgcttgagtccaggagttggagaccaactgggcaacacagcaaaattccatctctactaaaaataaaaaaatggccgggtgaggtggctcatgcctgtaatcacagcattttgggaggccaaggcgggtgtatcatttaaggtcaggagtttgagaccagcctggccaacttactgaaacctcttctgtaataaaaatacaaaaaaattagctgggcatggtggtgcatgcctgtaatcccagctacttgggaggctgaggcaggagaattgcttgaacccaggagtggaggttgcagtgagctgagattgtgccactgcactccagcctgggtgacagagcgagactctgtcttaaaaaaaaaaaaaaaaagtaaataaaaattaaaaaaaaaattagccaagcgtggtgacacacacctgtaatcccagctacttaggaggctaaggtgggagaatcacctgagcccaggaggtcaaggctgcagtgagcctcaccactgcactccagcctgggcaaccagagtgagaccctgtcttaaaacaaaagcaaaacaagaatcaaggtcagggctggcttcatgtgtgtgtgacgcattcactctcacagggccccaggcttggatgggctctgcctttggttttatgctctgctgtcactatcaggaaattcttaataattatcgaacttgagaccctacattttcacattcacaaggccctgcaaattctgtagcaattcctggggaaaaacaacagaattgtaggaaatacaactttaaaagtgtgtcaagcctgccgtggtgagatggcaccattgggccaccactagttaggatgtcttggctgcaagtgacagaggctgagctgcccttgtgcatggaattggaggtcctgtggcaggactttgggagcaactcagtccccctctcctggtctgttcctgtgtcactctgggctgaatggctctggaacacacagcctgctggacatctgggagtaatagagacaactgcttccagaagaactgataagaatattctcagaaagcccagcagatctttttttccctttgccttgttatgaattatgtctcatgctcattccgaaaccaatgagtggcaaggagtctggttactcttagacctggagctgacagtgagttgaccagaactgaacagcagtccttcagaaaggaggaaggcggatgggtgctgagcaggtagccagcagtatgcaagcctgagccaggtgtgtggtgtctactagctgcccccttagtttccaatccacagccctttctaaccaacttcaaccctttaaaaaaatgttttcaaatgaatgtttcaaattgaatatttttagatgcactttttagttagttagttagttagttagttttttgagacagggtcttgctctgttacctaggctgtagtgcagtggctcaatcatagctcactgcagccttgacctcctgggctcaagcagtcctcccacttagctttcccagtagctgggattacaggtgcctgccaccacatctggctaatttaaaattttttgtagagagtggatttcaccatgttgcccaggctggtctcaaactcctaggctcatgtaatcctcccacctcagcctcctaaagtgctgggattacaggtgtgagccactgttctcaaccaggacagggttatatgtggcagcatttcaattttttaatggttttttttctctttgatacgtgtattagtccattcttgcattgctgttaggaaatacctggccaggcacagtggctcatgtctgtaatcccagcattttgggaggctgaggcgggcagatcatctgaggttaggtcctggtcaacatggtgaaaccccatatccactaaaaatacaaaaattagctgggtatggtggcatgtgcctgtaatcctggctacttggaaggctgaggcaggagacttgcttgaacccgggaggcagaggtttcagtgagcgatcatgccactacactccagcctgggtgatagagtgagactctgtctcaaaaaaaaaaaaaagaaaaaaagaaatacctgaaggctggatgaggtggcccatgcctgtaatcctagcactttgggaggctaaggcaggtggatggcctgagctcaggagttcaagaccagcctgggcaacatggcaaaaccccagctctaccaaaaatagaaaaaattagacaggcatggttcttggcatgtgcctatggtcccagctactcaggtggctgaggtggaaggatcgcttgagccagacagaggtggaggttgcagtgagccgatatcgtgccactgcactccaacctgggtgacagagtaagaccgtatcttaaaaaacaaacaaacaaacaaaacagaaaacctgagatgaggtaatttaggaagaagagttttaattggctcacagttccgcaggctgtacaggaagtatggcactagtgtctgctctgcttcagaggaggggaaactcacactcactgtggaaggcaaaccggggtgggggggcggggggggtggcagagcaggcatgtcacatggccagaacaggagcaagagagagaacaaggggaggtgctccacacttttatttatttatttatttatttttgagacagggtctctgtcacccaggctggagtgcagtggtgcaatttctgatcactgcagcctccgtctctctggttcaactgattctcctgtgtcagcctctggagtagtgtgtgccaccatgcctggctacttttttttgtatttttagtagagacggggttttgccatgttgccaggctggtcttgaactcctgagctcaagcgatccacccacttgggcctcccaaagtgctgggattacaggcatgagccactgtgcctggccatgacacacttttttttttgagacagagtcttgctctgtcgcccaggctggagtgcagtggcacgatctcggctcactgcaagctctgcctcccaggttcacaccattctccagcctcaacctccctgagtagctgggactacaggcgcctgccaccacacccagctaattttttgtatttttaggagagacggggtttcaccatgttagccaggatggtctcgatctcctgacctcgtgatccacccgccttggcctcccaaagtgctgggattacaggcacaaagtgagccactgtgcctggcccatgacatactttgaaacaaccagatcttgtgagaagaggataataccaagtggattgtactaaaccaatcacttcccaccaggccccaccctcaacgttggagattacaatttgacaagagttttgtgtgggaacacagatccaaactatatcaatacatatttaacacatatattttgcaatacatgtactttaaagaaaatttggaaaatacctggctaagcagggtggctcacgcctgtaatctcagcactttgggaggccgaggtggatggatcacttgaggccaggagtttgagacaagcctggccaacatggcaaaaccctgtctctcctaaatatacaaacattagccgggcatattagtaggtgcctgtaatctcagctactcgggaggctgaggcataagaatcgcttgaacccaggagatggaggttgcagtgaaccaagatggcgccacggcactccaacctgggtgacagagcgaaatcctgtctcaaaaaaataataaaaataaaatacataataaaaaaataataatagaaaaaaagaaaattaaagaaaatttggaaaatgcccccaaaattcagtttttaaaaaactcatctctagtcatctaaagtggggtcactttttcttgctggaatgtgtgccatccagttcccctcctgggggcaacaaatgttaaagtatatatatatatatatatatatatatatacacacacatatatatacacatatgtatgtgtgtatatatataacatatatacacacatatatatacacatatgtatgtgtgtatatatataacatatatacttatatgtgtgtatatacatatacgtacatatatatgtgtgggtgtatatatatatatattctacctattcatgtaattgtagttaacatttttgtggatttcttttcagtgcctttgatgtgtatgtgtttcagattgttgtcatgtagtgcatcaaattttatactctgcttttttcttgcccttttcctctaatgttgtatcatgacattttctcctgttattctgtagtctttaaaaactaattttcagtggctgcataatacttggtttagtttctcaaaaaaaagtttagttaacttctgattataaaggtagtaattgttctttaaagaaacttggggctgggcgtggtggctcaggcctgtaatcccagcactttgggaggctgaggcaggaggatcgcttgaggtcaggagtttgagaccagcctggccaacatggtgaaactcatctctactacaaatacaaaaattagctgggcatggtggtgcgttcctgtaatcagtcccagctactctggagggtgagacaccagaattgcttgaacccagtaggcagaggttgcagtgagccgagatggtgccagtgtactccagtctgggcaacacagtgagaccctgtctctaaaaataaaaataaaaaataaagagaacttggaaataagataataccatattcatctacttcaagatgaatattttttcaaatgttcacgtctctgaaattgggatgcttcttacaatagctgtcagccaggttaccttcacttagatgtcactatctgtatgagtaaaccatcatggcagttcattatgaggtaagtgcattgctggtactatatttgttgagtttaattgttttaaaaatattttcaaaaagatagtgtgatttagcactgaaaagaaaagcttttgtgaacacaggcacagaaacaggacaacgacgagtaaatttcataataagggagcaaatatttgttgttggaggaaggactggaatttcctaattccatgtcaagcaaccaaattcttcatagccacagaaaggaaggtaccacctaccctcaagttggtgagactgggtcatttttttttttctggaatacgtgcaaatagattgtgtatcatgggcctttgcagaataagtattcatggcttgaaagaaaactccaggaagagtagtagaggactctaagaattgccacattaccattgttttggaagacacagaggatgatattgtgtagacatcaatgactcagtgttgggctctgaatgggaagaaactttaggaatacctgaacaaaccagtttatttatttcacttgtttttccttttttttttttttgtattcatgaatgatacttaacaagaaacacacaaagctatgtttaagcctaaaataattcttttgataaaagtaattttaattttttaattttttgaaacagaatctcactctgtcacacaggcgcagtcttggctcactgcaacctccacctcccgggctaaagcaattcttttttttttttcccacaagaagaaaaagtacattttatttaatgaccaagtacacacacacattcacacacatgcatatgtacatataactaaaaaaaatattttttctcatcacatgggatgcattgtgaaatattctacattctttcatttaaagaaaaatgctggtcacgttttagtaaaaatctttcacaaatcactaatatgttacaatgcataactgctctagagcattaacaatgctaagctataattttagggaaatatatagtggtgctccttcttagaattagcccatgtggtattttaggtactcaactcagggaaaaaaaaaatgtaacatagccttgttaccatgtattcagcctggacatggtacatgctttcagtgagcttaaatcacctatcttcctaggcccaagatctgagggaatgacttccaactacgtaacaggaccctttgtctgtattatacattttatatgtctttttatgtacattgtttcacttgttcctcacaacaaccctgtgaggtagggaggggaaaatatcagttacgctttatagataatgaagttaaggttcagagaggttaagtgactttctcagttacctagtaaaaggcagagacagaataagaactattaacttttaggttgggggcccttttctctaaaccacatagctttggagagtatattctaacccaaaatatttttactgcttcatcctcattttcttattattaattcaactttttacagaataccataaaagacctaattctaaattcatcatgctaaatttatgcttctctgtaaacttatggccacagaatacatatttttttttttggaaagcactgtcactttggccctaaaggaacataagcaatataaagggccccagaggccaaggaaattgaagagaagtcagaagaagggatataaaatggaatgtgttaacggattttagtccctttaagtttgcacttttgtgagagggttcaatggagagctttaatgcagatgagacttgaagcttttgaagaagatctaagtcttgatgaggttattcaaactcagatcttgaacgcataatgatgataggccatggtcttcaaaaacgtggtacttgatgctctcccacagtgccaggactggaatgtcacaatacatatagattcatgtttttgtccattaatggtctgtgggtttctttaaatgaagcccattttagagtccatagatatcagtgttctgcgaaactgttggggattggaggctcccaaaagaccccagatgctctgccctgcccatggcatcaccctctaaagcgattcttgtgcctcagcctcctgagtagctggttataggcacatgccaccaagcccagctaagttttgtatttgtagtagagacagggtttcaccatgttggccaaactggtctcgaactcctgacatcaggcgatctgcctacctcggcctcccaaagtgctgggattaccggcatgaaccactgtacacagcctgataaaagtaatttttaaatacaattaaagtttatgtgcaaagaaagcatttgtgttagtttatttgccagcatgttttttttttcctaattgtatgtaaagtaaaattgtgtcttataaaggatggagtcttggagttgacgaaacaccgtaaaggaataactgagtgtgtaccatggtttgcttaactcttctctactactattcaatactttaacttactttctctttttcggaacttctcacttttatcattgttacttgtaatagtaattactatataaacttaatctacttaatcctttacaattaataaaatatttatatatttaatgatttggtaataaattcccatggttcaaaatgtgcacaggatatacagggaaaagtctcccacccaagactgtccctagccatccagttcccctcctgggtgggcaaccagtgtcgaagtattcttctagaaatatatatattctacttattcctctccctttttataatactaattgtagcattctctataccactattatcttgatatttactgggtgctcttgcttacattatatacattaaaaacttacatgcaaaatttgtagccacacaatagtaccggcaagttggcaggcaagtatgattacaacttaacaggtaattacactgaggcccaaagaggtgaaagtgatttcctcagtgacggagcttggattcagacctgagtcttctaaccctgaggtgagcacaggaattcgatgtgtgagtggactagtttctttcaagtcacaccattcttccttgaaatgccagttagtattcgaaactcctgggtgctggttggagtctaacaatagggatccacacgtggcctttcagggatcattaagtgctggtgtaactgttcatcacacctctaaagggggaacatggattctgcatataggcagtgcaaaagcatagaggtgtgggaaaaccttgtgaggtggaggggaattggtctgtactgctggcttttcctgcccctggctgttcatataacctcttcaggatttgccttagcagttctgtcatagggctaatttatccatgcagtgtagcaatgaatataaacaattctcctgcacagtgatagtggaggtgctgaggggcacatagcagagaggtaagctaaaaggaactgttccacagagatttctgtagctcttgcatttctgagcctgtccttggtccccttgtatgacctcacttgttccccaagttaaattctcttttggccactcctaatgctgcttcctgagtgcttgccaagtataattcattttacttatgaggaaatgggttcagatatattagatactaatcgagaattggccagtggtatactggtagatgtttaaagatcaaccctcggggagaaaacatggccctgatttgtagcatttgctggcttctgtgatgttaatacttccatcttggctgattaaatttgaagtgaaggggataaatgcaggatggccagagatgtggttactgaaatgatcagcatgtccagagacatatggtgaaatcaggagagtttgtgtagataggacagtgtttggcttagttcagggttggtgtcccataaagggaatctagtcgtggtataatccctgatccccactggtgcagtgttaaactttggctcacgtgccagtctccacattcagagccctaggacttgccacataaccagtggtgactagggtgattgggatggtggttggggaggtaaagtagagagattagcacttccttggtgctgcttccatgcattaattcattagcctagcagtaaaacctggcacctatccttctcccagaactctctcctgggctgcttttcttccatatcttcagcacctgggggcctggggatgtcctctacctgaggaggtaggaggctaggcttgggggtaaggcagagctacatgtgactgacttcttgccctgccctcttccagctctgtaccttgagtaggtaacttcatcactttacaattcaatttcctaatgtataaaatggaaatgatcatacctacttctctggtatctttgtagcagggagtagagtcctatgacccaccatgtctctaaccccctcctgaggcctaggagcctcctcccaccaggagaattccttccagctaccaagattggtatgtagaggcagcatccccagcatacagcagctctgacccactctctcatgttctaggaattaaccgacttgcagagggatcctcctgcccagtgttctgcaggacctgtcggtgatgactgtaagtattttggggggcttcaagttgtaggagcattttaattaagaccccccaacttaggccaggtgcggtggctcacgcctgtaatcccaacactttgggaagccaaggtgggtggatcacctgaggtcaggagtttgaaactagcctggctaacatggcgaaaccccgtctctactaaaagtacaaaaattagccgggcatgctggcacatgcctgtaatcccagctacttgggaggctgaggcaggagaatcgcttgaacccaggaggcagaggttgcagtgagccaagatcgtgccactgcactccagcctgggcaacagactctgtctgaaaaacaaacaaacacaaacaaaaccaaacaaccaaattatcagccaagcagtatttaagaaaaccaatcaatgcttttcccttcattttctcttgaatggcttttcatttgaggtctaggccatgagttcacagcagcttggctggtcagcttatactcaaagtagaacctgcactgcctctcatgtcccatagtcaccgcttccctcttctggcgcatgagaaagccagcttggcctgaggagtcacatcagctgctggaaagtgcccttggccaagtcaaacttgggtgctggtgtaaatattgttggagttggtctagaggacctggtgctgctgcagctcctgggagcagagcaggacagtggaggaggggcagggcagggtagggcagtggccacttgcctctgccaaggggaagggcagtccctattattttctcccacttccactcttccctggcggagactgaagcagcagctctgggcagcttcttgggagagagagggagaagcagcactgcctgttccaggcctctgctgtccctcacaggtgctggccgaggctgagctgcccagcactagggtttccaggtctgtcctctgcccactcaccttgcctccactttgtgggcttcttgggctctgggacaccaatccttccctgtgaggcttcagtaactgcagccataggaaaataggtggggaggggagatactatgtgttcaaggagagtggtgtcagaggtacatataccaaagaatcaaaaacagagtgagacagaatgtgtatgccaatgttcacggcaccattactcatgattttcagaagctggtaacaacccaagtgcccatcagtggatgacagataaacaaaatatggttctgatacacattacaacatgaaaacatcccaagtgaaataagccggaaagaaaagaatgaatatatgattccacttacatgaaatatctagactaggcaaattcatagagacagacggtagatgagagattacctgaggctgatggggggtggaaataggagaaatattgtttcatggatacagaatttgttgggggtgatggaaagctttagaaatggatgggggtatggttctacagcattgtgaaggcatttcatgccacagaattgtacactttaaagttgtttaaattgcatattttattatatatttttaactacaataaaaagaaatttcacaaagctggaaaaaaggagggcatggcatcatatgtgtgcctgcatgtcctgggaggggactgagcttagaggagccagcggtaggcagatggagccactgaaaatggaggactctaaaggctttatgtgggagtttaaatctcatttctggagcagagcagaaatgtttcccagctgcctatgcagagtgtaagaaacaagaatgactctgctccactgtctcctggtacctgctcatcactctgctccccactaatcagtgtttacctcatgtcgtcctcacaagcaccccaggtctccatagcatgcttcccctcttacctgtcacttaagataatatcagattaaactggggtcgctgtaagcttgaactagttcttgtttagccttacctgtctagaggcagctccttgatgctcagctcagctcaaatttaccttgcaccagagcccagtgctaagagaggctagcatcaaggctagccaccacagtcagacctcagtggatgaggttcagacagcactggaagctagcctttggggccatttcacacccgcctcatgggctcacagccatttccagcatccctcctgtatatcctttctcgtcctcttgcttttggggccttctcttctgactctgctctcaagcactgcttagtgtcccagcagccctcagggttaaagtgaacaagaccagaggattctaaccttccgttctgaaatatattatcaaaacacttttatttaataaagaattccattcacattaatgttaggcaaaatatgtctactttcaactaacgattagcatgaattggaataaaaacagtcaaaagcaaaaaaaagtgatatttttattaactcaggcaggcttattacaggtaaaggtgttcttttcagcaccatttctttgaaatattgaaaagggctcatgggccaccttgactacttttgaacacctctaggggcttgggaaacttctgctttagtccctgcacttgtgctcccaccccaaaccttggtgctttcctaggcctcctgttgtgtagagcctgtggggtacttaaacaggtgacaggaaacccaggacaggaccaggtctgaaactctgggctaattccatatctactatgaatccatatgagacagaattctcttggtaataacaggcccttcagatgatcccagcaacccactcctgtgggtgagtaggcattttccaccaaggccctagagtcaatatccctgggaccatttgtatgacttgggagccttgaatgtgagtgtttgggccatactgggctagccttgctgatacacaggagcttttctgggaatgggtagagcagtgaaagtcacctgagatgctggagagggtgtgatgtgcagcaagagggggctctaaactctcaccaaatggtggtgacctggaagggaagcatgagaggggctcatcgtgaccttgttactgagtgcctagagcacagggcactgcccaggggttgggcaggagaggactcagatgaaggcagcacccttgaggctccagggccacgggcagttggctcctgagagacactctttgaagagggcttcacaatgaatcaggagaagaaccaaggaatagaagggtttataaagagcaataaggaaaatggctgaagcctagccaaggcttaattctgtgcaaagaactgactgaattgtagttactggcatttgtgtagtaaagaatttaatcttggctaagcacagtgtctcacgcctgtaatcccagcactttgggaggctgaggctagcagatttcttgagcccagcctgggcaacatggtaaaaccccatctctacaaaacaataacaacaaaaagaatttaatcttgtccccaaaagatctggccttcatccttaacacgtagggggcgatctgtaagataccatacctgataggaatgtctttgtttggctggaagctttaatgcacaccaacaatgtgatttagggtgaggaatggccataccaagtagaccagccatgtgatttcaggtgagagcctagcccgggcaacatagcaagaccccatctctacaaaaatgaaaaaataaaagtaaaaaaattagccagatgtggtggcacacacctgttgtcccagctcctcaggaggttgaggcagaaggatagcttgagcccaggagtttgagactgcagtgagctataatcatgccactgcccaccagcctgggtggcagagtgagaccatctcaaaaaactaaaaaataaaataaggtgggggcttggatcatgcctggaggagctggagactggagcctgagatcagtcctatgggcattcaaataagtcagtcatgctctcagggtggagctccaatgagaattctgaatacggaggctccagtgagcattcctgattgggtgttctgtgtgtgttgccatacagcaatgccaggagagtaacacatcctgactccacggagagagaagaatagaaactctgcgtttggaccctcctgatgttaacctatgttgtttccctgtgataaccagcaatcttaagcacaaccactttcagtgagctctgggagtcctaggcagttattgcatcttgggtggtttggggaaccccagtcttgcagttggtgtcagaagtgagtgcatcttgtgtagacagtgcgctgtaatttagcagtgcgttttcagtagaatgacatgtttcttggggggtctcttacatgcccgtctctcttttgttttgtagtgttccactggcaggccaccatcatgggcccggtaggtagtagctgctgagcgcaccactccagttttgcttcttgcactttgggcttagcacatgcactgatctctttctgtgtctcatccttccagaatgacagtccttaccaaggaggtgttttcttcctgaccatccactttcctacagattacccgttcaagcccccaaaggtgaggtccctctcccaactcccctgatgtttggatgaaggacagcatgtgacaaggggcccttcaagtcaggtataggtaaaaagagctgtacgtggggtttctctgagggcccactgctccaccctgtggtgagagtttcccaggactttaattactggactttgggaattagcacctgttgtgatcaagggtcagtggggtgagctggtgctggccttactgaggccacagtttgaatgcttctccttgtgactgtagctgagtctggtcatgtctccaggctctggctcccttctctgcagtcccttagagttaggacaggggttctcagccggggtgattttgctactgccccagggacatttgagcaacatcttaggatattttgggttatcaaaaccgtggtgagggagtactactggtatctagtcggcaaaggccagggtattccagggattccctgcagtgcacaggagagccacccttcccatgacagataatgatcagccccaagtgtcaatagtgccaaggtggacacaccctggtttaggactggtgagtcacaccttcacttttctttattaagttaaaagaatagcaagcctcctttgcccttcatgcacacaccatcccatcagtggagctttagagagcagtgccaccaaagggaaggagaagcccagggagctgcctcgaccaccctgccctagcatgtcttgtgcaccgcaggtcgtctcactccctggacccttggacctcgtactccttctcacctgggctctgcatgggtggccgagcctgccctgaggctcatagtcctgtggaggagacagggcatttagcatgtgagctactcagcactgggaaggagcacaagcagtggttggcagcaggagccagggtggtggagagattgccctgagaaaggggaactgcaggagctcagcaagagggcggacaggtccccaggaaactgccccaggggagtgagcctgtgaggagttgggaaggaggccagaggggtacggatggccccaggagtagggtctgcacgccgttgtggggatcgccacaccgacacaatcactctgctgccttgtggagaaaaggctggggttcaagtgattctcctgcttcagcctcctgagtagctgggactacaggcactcgccaccacatgtggctaatttttgtgttatttttagtagagacagggtttcacaatgttggccaagctggtctcgaactcctggccttaggtgatccacccacctccgcctcccaaagtgctgggattccaagtgtgagccaccacgcttggccaggttgtgcattttgtcaagacttactcgaaagtcctgcatctgcatcagaccccttagctgaggggttgtgatattgctatgtcttactaccttgacttggccttgatgcctcaatttgagtcagaggcttagctgctgttttgcatgttgtttatctgagtcaatgtgaagaagccccttctgtgctcaccagctgcagctctgtccagacatcgccaccagaggctacctggtgcctgagcattttaaatctttgttaaatatgcttaggatcccagagaccttttaagcttttagcaagggagtggagtgtgctgagcaggacaatgacagatgctaaaatagcttcaccacattggagtacaactgctgttcaagggagtttggttgaaaaatcataagcatgcttcatggtgctgtgatccaccccttctcccttcccctctggagagactgtggcagagtcttatcaagtagtaattttctagcttgtctctttcattactgtgtgagcagctgaggattttccttaaacagataccaatgtagtcctgaatgtctgttgggcattttcagcatacctaattgcctaaggacaaaggagaaacagtgattattattattattttttaattattattattatttttgagacacggtttcactcttgtctcccaggatggagtgcagtggcacaatctcagctcactgcaacctccgcctctcgggttcaagcgattcttctgcctcagcctcctaagtagctgagattacaggcacccgccaccacgccggctaattttttgtatttttagtaaagatggggttttgccatgttgggcaggctggtctcaaactcctgacctcaggtgatccgcccaccacggcctctcaaagtgctgggattacaggcgtgagccaccgtgcccagccaacagtggttattattaaaaaactaagaagtaagctctgtgggtgagttgggattattttaacaaggagagatgtgagctgaaaggtgacagtgacactctatgagagaagaaagtgcttctgtcttttaaaaatctccttccacaggggaacaggagcaacgatttatgttttggcacaaattttctgacaataggaggaatctggcaagattgcatgatctttattggagatattgaggcagatacttaatgtctgcgatgattttgaagtttgacccttcctgggaaaaattacagatgttcaagctcacatgcacacaactctcttctcatattcgaaagtaagtttaaaaaaaactattaaaaactatatcaaacatgcaaaaaattgtagataatgatataaaggatgtttgtgcatcctccatctagactaagaagtaccagtgagttctcaaagctagcggaggaggcaaaatcccttttttttttttttttttttttttgagacggaatctcgctctgtcacccaggctggagtgcagtggcgtgatctcggctcactgcaacctctgcctcctggattcaagcaattctcctgcctcagcctcccaagtagctgggattacaggcatgtgccacatgcccggctaatttttttgtatttttagtagagacgaggtttcaccatattggccaggctggtctcgaactcctgaccttgtgatccacccacctcaacctcccaaagtgctgggattacaggtgtgaccactgtgcccggccggcaaaatcctatgttcctttgccccagcccctgcgttggggtcactgctcacccagagggagtgtaggtgaggcagattcttaggctcctatagcagtacaagctgcacctgactcagagcaccttgcacatcacagacagcggactcttcatgggtcccacaacatccctgggagaggtaccatgtacctacttatagtgaaggctctgaggtccaaggtcatttgaagaagtaatgtgtggctgtggtttaaaaaagaaaaaaaaagtcaaatgtaggacagtatacagtagaaaataggaccttctttaaactttgtctctctagccacgcctggcccccccgccttttttttccataaggcattgagtcctacttgtcttttcatttctcttccaagagtaatctcaacctggataagcacttgtttgtgcttccttgtttttcccatgaatggaacagacctttccgtgaatctgcatcttgcttttcccatagcaatatatcttggaaattgttccatatgatcacattcatgttttaaaaattcacctcattctttttaaacaggtgtaatattctgttgcttatatataacattaatttaaccagtaatcaatctgaagacatttaggttttacatcttttgttacagtggttatccttacatatttgaagtgcacaagggtattttagggctaaattctgagaagggggggtcttagaaagggtgaagtagaaaggtggggagggtttgtggcctggcagagggtccacggcctgagcttctctttttcttttttttttattattatactttaagttctagggtacatgtgcacaacgtgcaggtttgttacataggtatacatgtgccatgttggtttgctgcacccatcaactcatcatttacattacgtatttctcctaatgctatccctgcctcagcccccaccccccgacaggccctggtatgtgatgttccccgccctgtgtccctgtgttctcattgttcaattcccatctatgagtgagaacatgcagtgtttggttttctttttttttttttgagacagagtttcgctcttgttgcccaggatggagtgcaatggcgtgatctcggctcaccgcaacatccacctcccaggttcaagcaattctcctgcctcagcctcccgagtagctgggattacaggcctgcaccaccatgcccggctaattttgtatttttaatagagatggggtttctccatgttgaggctggtctcgaactgctgacctcaggtgatccgcctgtctcagcctcccaaagtgctgggattacaggtgtgagccaccatgcctggcccagtgtttggttttctgtccttgtgatagtttgctgagaatgatggtttccagtttcatccatgtctctgcaaaggatgtgaacttatccttttttatggctgcatagtattccatggtgtatatatgccacattttcttaatccaatgtatcattgatggacatttgggttggttccaagtctttgctattgtgaatagtgccgcaataaacatacatgtgcatgtgtctttatagtagcatgatttataatcctttgggtatgtacccagtaatgggatcactactgaatcaaatggcatttctagtactagaggaataccttgaggaatcaccacactgtcttccacaatggttgaactaatttacactcccaccaccagtgtaaaagcattcctatttctccacatcctctccagcatctgttgtttcctgatttttaatgatcgccattctaactgctgtgagatagtatctcattgtggttttgatttgcatttctctgatgaccagtgatgatgagcattttttatgtgtctgttggctgcataaatgtcttcttttgagaagtgtctgttcatatcctttgcccactttttgatagggttgtttgattttttcttacaaatatgtttaagttctttgtagattctggatattagccctttgtcagatgggtagattgcaaaatttttctcccattctgtcggttgcctgttcactctgatgatagtttcttttgctgtgcagaagctctttagtttagttagatcccatttgtctattttggctttcgttgccattgcttttggtgttttagtcatgaagtctttgggcctgagcttttctgctgatacatcaacaaaacatcactgctttttgcataaaacttcctgggcttttgagtcctttccaccacccttgttattcctcagagcatactgctttcagggagatggtatcaatccccctatgttcagaatgagaatccagcagggaatgggtcagggaacttctgggtgatcactcactcccatatcccattagagtttgggagtgggggtctggcttagcctgcactgtggggccaggtatgcagcacactccaggtactgcccagcagcagctgcttctgctttacttggttcatttcccacacgtccctgtggtttgtctgattggggatctcttgtctttgcaggttgctttcacaaccaaaatttatcaccctaatatcaacagcaatggcagcatctgccttgatatcctgcggtctcagtggtctccagcgttgactgtgtcaaaaggtagagatgctgatggcatgctctgtgtgctcttttacacatgtttttaccccagcactgactgagtggaaatggaagctcagagaaagaagtcacctttcccaggtcacatagccctgtccactgctgtgcccttaagtggatatccttacacgcctacgaggcagcaccagcagaactttgtgccccgctccctggcgcttctcagcagtcaattgccctggtgtgctcaagactgtcacatgggtgcaagaagaaaatactgattctacttatatttttttatccaaaaataagaaaggcaaatattacattaccttctctgttccctcatttattcatctaataagcacaaaacggactgtgagtcagccctgaaggaagatacagggcatgcctccgggggcctcgaagttggtggagaaatcctcccttcccaaaataaatgatgttgagcacatgtctttggttgaagttgaagaaaccagtctaaactgagcttagaaatgcagatattccttctgaattaagatgggctgtgcatgggctatgtatgcacgagagacctgaatgtagatggtgcagtatcctggcaggtggagcgtgggaggatggtgaaaaatcaacccaagagaaacagagcctggcctaaattttaaatttttctgtagaggagacagggtctcactttgttgcccaggccattctcaaactcctggcctcaagcagtcctcccattgtggcctcccaaagcactgggattataggcgtgagccactgtgcccagccaagtatcttaagaaaggcaaacctgcccctgtcatttgtagctttatgtgtggggacctgtggtcagaactttgatggactcactgaatccagtttgtttggaatcatatggtgagtcgaaagcaaagccaggaatgaaagtgtgcatttctctctgggaccccaagaatccaggcaccacaattccttctgctcctcaccacagccctagtgggtgattcccttcccctagggttgctgagagccacattgagtgcacatcttagagacggtgctggcacagaggaggatgcatctgctttgcagttagaaggacctggttcagaatttctttattttttttttgagatcgagttttgctcttgttgcccagggtggagtgcaatggcgcgatctcggctcactgcaacctccacctcccaggttcaagagattctcctgcctcagcctcctgagtagctgggattacaagcatgcaccactatgcctggctaattttgtatttttttagtagagacagggtttctccatgttggtcaggctggtcttgaactcccgacctcaggtgatctgcctgcctcggcctcccaaagtgctgggattacaggcaagagccaccgcacctggtccagaatctcattttaatccatttattgggtgttccaagtctgtgaccttggacaagttacttgaatgctctgaattcttgtttccttaacagtaaacaggactcctaggactaaatgccagaggttcatgatgtagggtacagacaaggatgggagggcagttggagactaagatggggtgcttcagtggagaaggggaatgagaaccaggatgcacccaggagggaagtatcctagcacagcatgcctcaggccacacagtgaggaccacctcggctgatacatgggacggggcaagtggtgcatcaagcaatttagattgggctgttgaagggaagacaactgcttggtcaaaatacagagtgcaagttcagggaagtttacccaggggtgacccagcagcttcgtggctacagctgaccaaccttttcttttcttcccagttctcttgtccatctgctcgctgctctgcgaccccaaccccgatgaccccctggtgccagagatagcacacacctacaaggccgacagagagaagtacgtgtcctctttgggttgcctttgcaccatggctgccccaggcagctccatgcagtacctgtgctctgagctggtgcttctaggctgcaggttcccacagacatcttcctgcccatgctgagccatgtgcacagagggtgtgccctgggcttggactcctggctctctcactaacatgtcctttgagtctaaggagggaaaaggagataaaagcagttcccctcctggataactcattagctgctgctactgtatatgaaaacattgccaagccctgccctcaagaccagcaaaatcagtggtcagccaagaacagactcagaagaatctgacaacaagaaaaattctgatttaaattctagggtttatagcctaagacaaggggatgtctgcttggctataccgaaggtgaggctgagggcagtcaaggtgggaaacactgctgtggtcagttcgctggctcagctcagaagtcagcagtgtgttagaccttcattgccagctctctgtttaaacaccaattaacagacccagaattgtaaaattccgaccccctaggccaggcacaaccacatgcactgtagcatgagggtgtctgtagttggtggggcaggcacaaggagtcatcgccaagtgttagtctctcagtgctgacagcactgtgaaagaggcccaggtgtggcaggggccgcagtccagtgagtggtgtgaatctcagttgtggaccttcagggaaggtattgctagcccttttaaaagacatcttcagtgagtgcattcttcagttcattactcattacttcttttctgtctgaagagattagaatagagtatgtttttcccttttttttttgagacaaggtctcattctgttgcccagtctgaagtgcagtggtgtgatcacagcttactgcagcctcgatcttccaggctcaacctatcctcctgcctcagcctcctgagtagctgggactacaggcgtgtcccaccacacctggctaattttttgtagagacagggttttgccatgttgcccaggctggtcttaaactcctggactcgagcaatctgcccacctaggccacccaaagtgctgggattataggcgtgagccaccacactcagccacatgtttttttcaaattatatttttcttaagacctttatagatcttattatttccctcattggagttttctcaataacagtcaaaatttttaattgactgggtttgtttattttaacactttttacaagatattttagacataccaaaagtgattttttttcagtgcctcttgtaactataaatctctctaatttatagtctcatagcatcaagtgtcattacaatgatgagagtaagtgcacacacctgcatagtcttcaatggatgcctggcctgctccatgtgctttacatacagacttctctagtttccccacaagcacacaaggcagatactttccccatggcaagcaatcaaaaaagccaggacacagaggggcggaacagctgctgaggactgtactgatgcacaccccggtaggcagattcccaagcccttgttctggagtttgtgtgctggacggcctgtaactagtacaaactgacctttgtgtgtctcttctctgtcctccctgcatccatattgtaggacaggagaaagaaagggaggaagtctgttgcattattaaatcttccacagcagatagttatggagaatcaacagtttggggtttacacatgaggggttcacccagctgggggtttacagccatgtctgatgtgctcctgctccagggaaagcctttattccactcacccatcagccgtagatgtttgacaagcagcagcagcagcattccccacatcagtcctgttctctgcagcacattgaagggaagtgaccatttcaagtgagggtgtcacttcctctgcttttttattccaggtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccacaccagggcctcagcctggcccctcaccacataccctttgccttttagaactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaaacctctagagatttgggtcatgttactccatttgatgaagattctcactaccgcccgctcctcccataggagcctacactaagtccaagtgtgagccattcacagactagaacacaaggagggagagagactcttaaacgtaaataaaaatgcaattcactcacaactct

SEQ ID NO: 38822 - DNA, 14746 bp, Homo sapiens
gtcgtgtggcctcagtccttcgccgtccctcgccgtccttcgccatcgcacgccaccgcaccccatctctcgaaatctgcagacatcttgatttttcccacgctgtctgtcaggtctccgccgccactcgacgccagggcgccgggtgagtccacagcagggcgcatggtcggctccactctcaccatcgggggaaactgaggccccggggaaggcggccagagaggtcaggccctgtccttggtgcagtgtctcgtcctctttgccggagtgagccccccaggattcgcgtgtcctcgggaaagacactggcgggtgagtcgcgcccttggccgcggcagtgctgagccggccacgtgcggtcgtcagaccccctgtccgcgcagctactctgcggggaggcttagtgcccctggatggcgggaaacagggctcggcgactttagctgcccgcccccgactcctggcattggaagcctccaaagccacttgactgttgcctacaaagtgtcagtcattgtgccacgtccttgagaccgttaactcgttttcccctcaataacttttaaaagtaggtgttagaaccttcattttacagaccagttagctgtggtttaaatggaagacgctgccagcactccagtggggcagagtctggacttctgtccccgggccttgtactaaagccccctccccgtgctttttccttgcctaggccttgtgggctgtgctgcacctcggacggcttcgcaccagccagcgccctctctctcctgcagcactctgatctgcaccccctgaggggcttccactgtccgcggggtgagaatgcccctgggtaagtgccgctgcttctgcgcaccttggggaaggacccttctgtgggacgcagtagaggggacagtcaatgagctcagccagttctgagttctgagaactgtctggcaaagcgggtgcagagcaaagcgtgacttaggagacgggctgcgcttggggtcacatgctagctaagttccttcattcccctgaggttgactttctgtaaagtagggaaactgcaaaggctctctgagggcagaggccttggctgtttttcttgattttgaacccacggtgcctgtccacgtgtagatactcagaactggtgggctgaatgtacagccgaggcatttttaccagaagtctgttttcctgtggactctgggtggggacagatggaatctgcctgtgaagtgatgatggctctcagggtcctgggtacccttctcttccctggggggtgagcctccctctggagatctggcagctaacacgctgacgtgggctcacctgcccttttttgcacctgtattcgaaagtgatcgtgggctgcctgtgccctggtcattgatagtgcagggaaagaaatcgcggaaagtgcttccccgtgtttggagggtccgctcctgtccctttcaaactctggagctttctcacacctccttctcaccatctttcaaatgcctcctggcacttggtgtcttattagtgagtgctccctgtgcaaggctcagtgcagggttccatgaggcgttcaccagggtctatgaggggtgagtccctgcctcaggattggtggtgaaaccacagctgcagcccccactagtcacaccctgtggcaattactggcttgattgtctttgcctctctctattgtgaccttgaggacagtgtcttgagttttgtttaatattttattgtatttttttagagacaggatctcactctgttgtccaggctgaggtgcagtgtgcagtggcgtgatcatagcttgaactcctgtactcaagtgatcctcgcacctcagcctcccaaatagctgggacagacagggtctcgctatgttgcccaggctggtcctgaactcctggcttcaagtgattttccctcagtcttccaaagtgctggaattacaggtgtgagccacttcgcctgtctcagtatctgagtcctgtctcttgacttacctggtgcttggtagatggttgattttcagcagttatggaacaaatgaaaaacaggagatgggccgggtgcaatggctcacacctgtaatcccagcactctgagaggccaaggagtgtggatcacttgaggccaggagttcaagaccatcctggccaacatggtgaaaccccatctctactaaaaaatacaaaaattacctaggtgtggtggcacacgcctataattccagctactcaggaggctgaggcacaccagaatcgcttgaacctgggaggtggaggttgcagtgagccaagatcatgcccctgcactccagcctaggcgacagagtgagactatgtccctaacaaaaaacaaaaaacaggagctggaaaaagacaactgtggctggtcgtggtggctcacacctgtaatcctagcactttgggagactgaggtgggtggatcgcttgagcccaggagtttaagaccaacctgggcaatatggcaaaaacctgtctacaacacacacacactagccaggtgtggtggcatgcgccaggaggtggaggttgcagtgagccgagattgtgctactgcattccagcctgggctgcagagccagaccttgtctttaaacaacaacaacaaaaaagacttcagttgtaaggtgacagggcttagcacattgatgcatgtcagggaagtagttttgagcaaggcagcctgtgtgggggtggtcagagctatttcccactggcccagtggtcatcccatggtgttctctttgacggtcttgtccgtgggccaccaggattaatttccccacaggattgtcattgtgatgtcagcgaccaaagccagaggtatagctaggcatggctgatagaagagtgagatgtgtaatcagccctgacccgcagatgacagatgggccatcctgcccatcatagcccttactgtgtatgctagactgcgccacgctggtgtgccacaccagaacctgtcctaggttcagagtccccttcagtgtactgcttcaggatcacaaattcaacaatatgtgcataagatgagacttaagctgtccctgatgactggttcttctctagatgaactcttcgtgttgctgagaccgtagaccactgttaacactagccaacttttaggaaatgtttaccacctggtggcttctgtgccagtactctccttgtcctttccagaacgggtttgaccaggtgatgtctagatagctcatccagggcttcttgattctggcagaggaggctgattggtgcagagaggcccatgagaggtatctccaccctgccaggaagcaggtggaccatggtgttctatgaggtctgtcctctggagatctggggctttgtgtcccacaagggtgggtgcatgcaggttccctgggcgtgatgtctgggaagtagagagaggtgaggtaagagtgtctttgtgctggccccagttttaccctctttggggccatcatgaatacattgggttcctcttgtgcctgcttgggtttagcatctttagggatcccttatcattgttgtgtcttggaatatctgactcaaaagctggagggctttggcatcaaacctacctgtaccttggtcccaaacgctttaccactactccctagctttggttctttttgtgatcttcagttttctcgtctggaaaacaggagtacgctgaggtgatttttcttaggatcacaccgtccctatcttccacgtccgaagaagtctgccagctttctcatctggagggtctttcctttacttctcctggttggggcaggttccgtttatgtgggacaagatggaagctgcttcatcctgtgctctgctgtgccactgtcctggctcaggccatttttcaggcttctgacgttggtctccaatttcaacaagccctggatctctttctgcccctgtgtgcaaagtgattacaggctgcttgtgtcttggttattggtaataaaggaaaagttacaaggttttcctcttgtgtagaggcaccattgtccatttcagacgggatgacctcaggggactgtgtcagtgaccaggatgggctagacaagctgtcagtacattcacctcctgagacactgattcccctggtgtgttttctgtgggtgaatatcgtggtttcctggacttgccataagcagtgccaagtgcatcagtcacatcttggcttcttgtgccctgcaggagtgtaacatgactgccgccccatgtgtgtgagaggcgtcctctgggagagcatggatcctgaggtcccaggtaagtggggtcctgctcagtcctctagagctcaagttctctgcaggttgtgaggccagaggtggttgggtgctgaggagtggggagtgaggacaccggtgaaggctgcttccctttgctcctgtctttgctccttcagcaggcagggacaggcctgggccctcttctgccttcgtggggctgctgccaagaaggtgctccctgagcttgattggggctctgagagtccctgacaaagaacctgtcatgttgagaggaaaaccatgtgttggaatggacagaggggctgcgtttcagattcaagcctggattcatacccagtgcccggctgagcggtcttatgtaagcctcagtggaacagatagccaatattgataccctccagcccagtctgttatttatttatttatttattttttgagacagagtcttgctctgtcgcccaggctagagtgcaatggcatgatctcagctcactgcaacctctgcctcccgggttcaagtgattctccctgcctcagtctcctgagtagctgggattacaggtgcccgccaccatgtccagctaattttttctatttttagtagagatggtgttggccaggctgatcgcaaactcctgacctctggcaatccacccgccttggcctcccaaagtgctgtgattacaggtgtgagccactgtgcccggcctatttttttatttttatttttattttcttttgagacggagtctctgttgcccaggctggagtgcaatggcgtgatcctgactcactgcaacctccgcttcccgggttcaaatgattctcctgcctcatcctcccgagtagctgggattacaggtgcctgccaccatgcctggctaatgtttttttgtatctttagtagagatggggtttcaccatgttggacaggctggtctcaagctcctgacctcagatgatccacctgcctcagcctcccaaagtgctgggattacaggcgtgagccactgcacccggccagcccagtctttgagaagagccccaggattctcaatatttctgcccatgtttgccttcctttctgcttctggcagggagtggtaagtgatctctgggagtcagaagcagcatctgtaatcttaggctgtaagtctgctcattgccctgtcagctgttctgttccaggtgagaccattgcccggaatgccagcattggcctcctttctgggcttgccctctgccctttctgcccctgcattcgaaagtgatcatgagctgcccgtgccctggtcattggtagtgcagggagaggaactgccgagagcacttccccgtgtttggagggtccactcctgtctcttccaaaccctggagctttcccacacctcctccctcccaccacgtcttagatggctcctggtgcctggcatcatctagtgggttgtgttgctcttctccctggcccagggcagttattgtgagacatgagggaagggtgtggggtgatgggtttggcctcatggagcagaagggctgggtgtggagctgagatagggctgccctgctccttcctcccggaagctttctctgcctccacacctctccttccacgtccttatccagcccctgcaccaagctgaacctgtggaaattgttgcctgacttgtttcctggctctctttgctgtggtctcaagggcagtgtctgaattttgttccctactttgttatgtctgccagatggtcagtattctgacagtgtgggacaaaggaaaaacggcagcctgggcaaccccgcctctataagaactaaaaaattagccaggcatggcggtgcatgcccctgtagtcctagcttctcaggaggctgaggcaggaggctctcttgagcccgggaggacaaggctgcagtgagccatgaccatgccactgcactcagcctgggcaacagagtgagaccctgtctcaagaaagaaaaacgagaaagggagagtccctccactgtaaggagatcgggttcattacattttggggtgttggagaaaaatactgagtcagcacctgtgtgggattggtgggagcagatttggtgttttccaccccttcacaggattctgaggtaactcatttctgttggccttggccttgtatggggaggatttccctccagccttgtatggggaggatttcccttgtatggggaggattttccctccagcttgtgggaaaggaatcaaggaccagagacaggcaggggagaagatcactgagggatttacggcagcagcctctgcacggcttccccacgacctccccagctgcttgctggacgctgctggagaaacagcacatcccaagatcatcatggccccagcatcctcttgaacttagtaacagttggcctgacagatgaagcggatatcatccctgccttagaagttctctagcccctttcttagagataagctgctatttcattcctaaaagaagtcatggctgttcaggtgagaagaacggtttagtcagcatctatgcaacactgtagagatgcttagtgagaggtgttgcaggagagtggcagaccgcagggcccgaggtaaggtttcttgtccatctctggaattttggctttttgcaccctgtaaagtcacgtcccctttttttctggtgctttggtggtgacgtagggagaggtgaggatgagaagaggagccatgtcctatggattcccagatccagactcctcttccctgggaaagctggattggagctggcccctccttctgtgccttcaggggctgtggaggaggaggcccctgcagggagctgcctggggcgagcgctgggggcttttcctgcagtgcattagcagcatgtcataatggaaagtggctggatttctttccagttgtaatcaatggttaagatttaacctagcaacattgtaggggtacacagccaaatgattcaggaaaaaagatgcaggttgagtctggaggaatccctgtgccagcttcctcatgctccctccctctctcagaaatcacatggaacccattctcccctcagcagtgaaaatgcattcagcctgtgtgcagtgtttctgcccagggaagcccagtagggcctccatgcccggggtgtttactgggatctggttatgtagacaccacctgcctagcacgcaccaaaattccagactttcaggaaaacaggtgcctgtgccacattatttgcacggagagactgtgtccagtgaacggttctgatcagtaaactgttgactaggaacatcccgagagccaagttcccagatgccagccaagggccatctgacctgttttgaatctcaatttcctgatacagaaaacaaaggtagggcataattgatttttacagacgtgaccccatgatcctgctctctagtccccagatttttccagggcttttgtcagaggtgtttcccctttgattccccttggtggttaggttttatgggattttacaggacagatggcagctgcaggagtcttgtactgtccctgacttgggtcatcccacaggccctggcaccatcctcctgcccttcctggctctcctgtctgtttctgctcctgcatccgaaagtgatcataggctgcctgtgcctaggtcattgatagtgcagggagaggaacgctgaaagaggttgtccccgtgtttggagggtccaccctatcccatccgaaccctgaagctttcacacaactcctgttgctctcctgccagcccttgaggagtccggcgcttgcttggctgccacatgaaagtcagtgcggggggacatcatgcttaagtctttctcagcttgacctctctttgcagaaaccaggctctgtgttctgaggggtagatcaggaagggaatgtgatatgtaatgagtcatggtgtgtcgcagtggatagcacagtttcgaataagtgcaatattggcatataaacatgagggagactttgaggttggggtgagcagggctgaccccgtgtgtgtgtgtgtgtgtgtgtgtgtgtgtgtgtgtgtatgtgtaacttggggacaggatagggtagcatctttacatctttacatgtcattggcctggaatagggggtcctgaagggtttgtcgtaagaaagagaaagtgctcattgctgcaaggggagcacagccgggttctgagaggcaaaacacttccctcacttcccacccaagagtttcgcctgttctctcgaccctctgaggtgtgcattggtgtcactcactggccaccattccagctcttaattcctctgccttttgtgctggcctttggggctcccctgaggatgactggttctcaggttgcccctggaggaatgggtggagttgtaagatcaggaataaagctagagagggaggaccaaggggaagtcactgatgcagccgccgtctagcccatcccaccccgattgagaggtcgctttttcctgttgaacatgttggatagtggaatgtgttataagaagtgatatgtgtggcttcttgtcattgcaggattgtcagctgacctctgtcctgtgtgcccagtggccccaggtgacgtgtcttcaagaagaggctgagctgcggtgcttgtaaggtatgaatcctgggtgcttctctagagaatgcactggtgttcaggctgcaaggacgaaggctttgaggtcactagaggggaggcagaggctgcttcccattgcttgctcttccactgaggcccacagggacatgtgacaccctcttttcctcgaactctgcgactccactgtgtgaatcacggtggggcttacagagctccccttgggctctgagtcatcctagtgtggattggcatagtttgttgaagtgggaggagtactgcattttggaggcaggcagttagctagtggttttctctggacttggtggcgatccttgttatgaagtgatttatggatttttttttttttttttttgaggcagggtctcattctgtcacccaggctggagtgcagtggtgcaatgatggctcactgcagcctcgacctgggctcaagtgatcctccacctcagcttcctgagtagctgggaccacaggtacgtgctgctgcacccagctaatttttagaaattttttgtagaggcggagtctcaccatgttgcttgggctcgttttgaattcctgggctcaagcaatccttccaccttggcttcccaaagtgctgggattatggatagtaagtccaggcctggccgacgtgtggatagtatcacacaatccctgacttcctaatccagtgaattctcaacatttcacccagagttgatcttccatctcattctcttatgagggaagcatttgagtagtggttctcaaactgtggtcccagaaccaggtaccatcagtattacttgggaacttgtaagaagtgcaagttcttagccctgtcccaacctactacatcagaagttttggatctggagccagcaatctggcttaacatggtctccaggtgattcgtattcatgctaaagtttgggaaatcaaaccatgttagaaatctttgggaatcagaagcagctgctgcaattctaggctgcaaatctggtcactgacttgtttccaggtctcttagtttgggcccttcctaagctgctgtcagtgcctcccctctcaactcactcactgccctattttgtccctgtattcgaaagtgatcgtgggctgcctttgccctggtcattgatagtgcagggagaggaatcaatgaaagcgcttccccgtgtttgaagggtccactcctatcccttccaaactctggagctttcgtacatgcctttattctcaccagtgatgttacctcctggtacctggttgtcgtgccagacccctgtttacctcattagggatggcaccaggttcaacaggccggagaagagacctggagccagtgaaggaaacagggtttatctggggaacttgagggcagtcagcagtctagtggtggggggctggatgggggcacctcatccacttgtaaaatgcatgcagattatatagcaccttcccccagtaacctccacatggcaaccctcgtttcctaagaagctattgttacatgcatctaccatacactggtgctgtatggttcattgagtgtcccttgtgcctagcatgggactcagaggctcctgtcaaaggacagtgaagcagggacctgccacactgagtttatgtctctgagctagttttggagccacagtagtggttaccccttcctagagctccccccagaagctctctctgcctccccatcacactccttcccacctctcagcactggtcacactgtctgggaattgttggtttgcttctcctgcccactgtgctgtgagcttcctcagggcagtgcctctgtcttgtttcacatggtgcctggtaactgacatgtagcacctggacaaacagtaaatgagaagacacattgttgtaaggtgacaaggcttatcccattgagcagtgctggggttaaaaatgtcctagaacaagccagctgttacagtccaccttcagtcctggctgtgaggagcgtccatggtctaccagaggtggattttccttctggccttagattaaggtggcaagggctagagtagtaatcgggggagacaatatgctataggtatagtcagatgtatgaatgcagctcttacacactagatggtaggtgcggggctctcccaccccacctgttcattacccatcccaggtctgtgctgatcactgccaggcatggcctgctccaaaagccttcttgccttggcatcctttttttctttttttttttaatttttttttttttgagacccagtcttgctctgttgcccaggctggagtgcagtggtgcaaacacggctcactgcagcctctgcctcctgggttcagtgattctcatgcctcagcctccgagtagctgggattaaagatgtgcatcaccacgcccagctaatttttgtatttttagtagagatggggtttcaccatgttggccaggctggtctcgaagtcctggccttatgtgatacaaataattgggacagcctcccaaagtgctgggattacaagcgtgagccaccacacccaacctgtttttaaaatgtttattgtctatatttgagtttacaacatgatgttatagaataatgggacagatatagatagcacagtggttactatggtgaagccgatgagcatgtctgttatctcacatagtcaccgtttttagtgtgtgtgaggagcagctgaaacctgcttcacagaaatcccttatgttgtgcgtgagccctctagacttactcatcctgtatatctgctacttggtgtcctttggcctacatctccctatttccttcagctcctgcccatggtaattaccattttattctctatctttgtatgcttgacctttttttttttttttttaacattgcacacataagtgagatatgcactgtttgtctgtgtctagcttatttcatttaacataatatcctccaggtccatccatgttgtggcaaatgacaggatctttctctatctttttcttttttttggttgagacagggtctccctctgtcacccaggctgaagttaagcccaggagacagaggttgcagtgaactgtgtttgctcactgcaccctctgtctcctgggcttaagtgaccctcccacctcatttccctgagtagctgggactgcaggtgcatgccactatgcctggttaatttttgtatgttttgtatagatggggtttcgcgatgttgcccaggctggtctccaactcctgggcttaaaccatccttctgctttcgcttccaaaagtgctgggattacaggcatggactgccatgcctagcccagggtcttcttttttttttttgagatggagttttgctcttgttgcccaggctggagtgcagtggtgcgatctcagctcactgcaacctccacctcccaggttcaagtgattctcctgcctcagcctcccgagtagctggggttacaggtgcatgccaccacgcctggataattttttgtatttctagtagagatggggtttcaccatgttggtcagtctggtcttgaactcctgacctcaagtgatccacccacctcggccccccaaagtactgggattacaggtgtgagccaccgcgcctggccaagggtcttctttttaagggtgaataatgttttgttgtgtgtgcgtgtgtgtgtgtgcgtatgccacattttctttttccattcatctgttgatggagacttagattgtttccgtatcttggcgattgggagtaatgccgcagtgaatattggagtgcagatgtctttatgaggtgtgatttgatctccattgagtatgtgtccagaagagggatagctgggtctatgtaatgtatactgataagcagcacagagtgggcacataggatagcatagatgccatttttctcacagatagtttgccgacctcttcctagagttacgtttttcttgttcctgagacaataatgtggctgtaagtactaatagagacagtggcatttgtgggttgcttatgatctgccagcccctgcgttaagtgttctctgtgtctgtttcagatgggtccgctgtgtgcagaggctccatgggatgtgttgtcttcatagtagcaggtcgctggaccatgggtccgcaaggtgggattttggactgttgtctggaatatgtttctttgcatcctgcagagtcatgtgctgttcctggggcttggatgatgtaggggaagcaaggtgaaagtggtatcccgtggttccacattctgtcctgctgtggggctgtccctcacatgctttcagtggctgttgcagaggaagagcctctggaaatctgcgtgggtaaagtgagctccccgggggaaccgtcctcctcccttgagcgctggtgtgtccatagtgtgctgtgatctggattagcagtgagtttttctttcagggtgtgtgtgtatgatgttaggaccatatgctcctgaccttttccaacccaaaagcgtttccatttttttaatgctggaagtgtcttaactccttttggggtcttagaaggacacacggtggccgtggctgggcctctgctcagctgggctgctctccctgcctcaggcccttgacaccagcctccctcccttgctggctctctttctgtccttccctgctcttgtatccaaaagtgatcatgggttgcctgtgtcccgatcattaacagtgcaggggtaggagtgctgaaagacatcttccctgcgttggtccagccttccctttcaaaccctggagctttcccacgctgcagcctttttccaactaggctttcagagcttgggcctttgtgggcccatgtgatgtggtgactagacccaccccctgacttctgagggttcattttgtcttttcatgttagggatcctcctgccagaaaccagtctgcatttctctctgggccccacgctggaatgaattcagatagcagtgaagggcacacgtgagaactgcgaatcacgggctttgcttcatgaaatgtgaaatccacattgtttccacaggcaccatcagtaatgtcgaacaaatggagaaagttgcaggtggggctaggaaagctgtattcctgtggattactctagctggtcatttgccccgattgtgaactgcttgaaagaaaaacgaaacttctaagatgtttgtcctttcatgtcctttctgttaggattttttatttggtgtgcgtgaatgaggagcttcgccctgcttgaatgggacccctctcagtggtgtcagcttggggaggaggagatggccctggagactaaatacttgtatgctttcttaccctcttaggtctcagccttagatccaaggacagtccaaggaagtcctaagaccatggagttggtgatctgggatctgggtttgctgatatttctcaccgtggtgagttgatgccaagagccagaacccacagccagaggctcagctggtccgtgtttatgcagatgggaacctcaaatcactggtctcacttgtcctttgtttcagaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 38823 - DNA, 22261 bp, Homo sapiens; identical to SEQ ID NO: 38413

SEQ ID NO: 38824 - DNA, 21331 bp, Homo sapiens
aacaaaatgggggtggggacgtgcaagtttcagactccgactaactacgcggggactccgaggcgctcagaaaaatgaagccgacccggccctgccccgagggacgctccaagagggcggaggtgcagggagggccccgccacaattcgcggtaacgcaagccaggctcgggcggaagggcggccggagccgatcaaaggctggctccgggcaggggcagcgagggagcgagggggagctctccgcaggccggtgtcccggaggaggcataattggagcagggcttccaaggtcacggagagacgccgggcaagacctcttaaggatcctcttccgggcttgaaaggcaggcgtcctcccgaaccgcgcgacccagccaagaagagccggggcggggccggggccggggccgggggccgactcgggaatcttcggccgaggctcggcaatccccccatcctccgtccggggcctccagcccggggccgatccggaaacagccgagcggatccggaaacagccgagaggacccggaagcggtgcgctccgtcaccagggagtgcgggaatccgccgtttgcgctgaggcaatggcggcagctgcgccggtggccgcggacgacgatgagcggcggcggcggccgggggctggtacgtgagggggcgtccgtgcaagcggggaacggtgatgctgggggcggggccgagccagccacctgcggatggggggtggagagggatgatggaggaaggggcggggccacgccgtcgggaaagggggcggggcctacagccacaggcaaaagggggcgtggcccggccattgaaggggtagggccagtgacaggtgcgaagtggggcccggtgaggaaggggcgcggccactaggagggcggggccaggtgggaccgaagagaggactgagtgaaactggccaccgcgaagagatggagtgtaggcagcacccggcagagcgagtgggaagggggcggggcaggggcggggccaggtgagccgggcgggcccaggtgaaggaggccccagatgaaggcaacagtactaggttgcaggacttgctaagccggtaggtggcctggggtaagagatgggaagagaggctgatccctgtcccccacagcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaaggtgagacgcgggactcacctagactccccatcaaccccatactggggagtgcatgacgagaaagggattgggggcacagataagctatgggataggttagcagggctgcctggcacagggcatgcctatggcccagaggaagggccgcccttttaaaatttgcatagaggccctccatgtgatagcagcagctctgtcagttatagctaagtttagctcccagcttctatctgttgccttgtcccatgtcatttcttgtccctcactgatgattgatcaaccctgaagatgggcgagaaacttctcagttccccaaaccaacctcattttagtctggacttctgggaaatagaatcagccctggcccagtctctgtgagtctaatgctctgctctctagccttccccagacactcccccctccaccccacgccatgcaccagcttccccacctccgccccacgttctttgtacttggtcctctggccccagacgccccagctgctgatcctgttttctactctccttcctctagcagaagccagagactctgaaacagatgtcagagctgcccccgctgctatgcccctgctgcggtggggctctcgtcaactctctcctggacttttgtcccaaccttctcacagatcttcctctatagtgtggccttgacattggcttccagagtaaacttcctaaaattcccttcccaacatgcgatttccctttctaacagctgctggtggctggagacttctctggggctgtatttcccacatttcaggatccacctgcctgtgcaatgtagacacatccttgtacaacttactgtgctgtttacttaatatttgttctttaaatagatccacattttaaaagtttacatacatttattaagggaaacttgttatatctactatataagaaaagccaggtgtgtcctaaataataacaatagctagctttttttttttttcttgagtcaataagagtttcactctgtcgcccaagctggagtgcgtcacagcacgctggtgtgatctcagctcactgcaacctccacctcctgggctcaagcagatcctcctacctcagcctcccaagtagccaagactacaggtgcatgccaccatgcctggctaatttttagtatttttttgtagaaacagggtctctctatgttacccagacaggtcttgaactcctgagctcaaacgatctgcctgccttggcctcccaaagtgctgggattacaggtgtgagccaccgcgcctggccaggtagcatgttttgagcactcactatgtgccaggcactgagctaaatgctttatgagtaactaatcttcataacaaactctgtgaggcaggaactattacccatctccattttacagaggaagctctgaggcccggagaggttaaataacttgcccaaggtcatatagctggaaaacagccaaaggttggaaaccaagcagcctaacagctgaacctatttttttttttttctgagacagtgtctcactgttacccagactggagttcagtggtgcagtctcagctcactgcaacctccacctcccgggttcaagcgattctccttcctcagcctcccaagtagctgggactacaggcgtgtgccaccacacgtggctaattttttttttcttttcttttgagatggagtcttactctgtcgcccaggctggagtacagtggtgtgatcttggcttactgcaagctccacctcccgggttcatgctattctcctgcctcagcctcccaaccagctgggactacaggtgctcgccaccacgcctgactaatttttttttttaatttttagtagagacggggtttcactgtgttagccaggatggtctcgatctcctgacctcgtgatctgcctgcctcgacctcccagagtgctgggattagaggggtgacccaccacgcccggccccattttttgtatttttagtagagatggggtttcaccgtgttagccaggatagtctcgatctcctgaccttgtgatccgcccacctcggcctcccaaagtgctggaattagaggcgtgagccagcacgcccggcccagctgaacctttacttctactgttagtgcacaataataggtcaatatctatacaaacaaaaaatgaccacgttctaccaaaaatcaaacaagtccatgttactcaggtgggaggatcagttgaggtcaggagtttgagaccagcctgggcaccaaagtgagacccttagctgggtatggtggcaagtgcctgtggtccctgctacttgggagggtgaggtgggaggttcacttgagcccaagagtttaaggctgcagtgaactatgattgcaccactgcactccagcctgggtgacagagggagaccctgactctcttttttttgtttttttgttttttgagacggagtcccgctcagtcacccaggctgaagtgcggtggcacaatctcggttcactgcaacctccgcctcctgggttcaaacaattctcctgcctcagcctcccaagtagctgggattacaggcgcccaccaccatgcctggttaaattttgtgttttcagtagagacaaggtttcactatgttggccaggctggtctcgaactcctgacctagatgatctgcccacctcggcctcccaaagtgctgggattacaggtatgagccacagcgcccgaacctgactcccttaaaaaaaaaaaaaaaaaaaaaaaaatctatgttctatccaacatcacctccatctcctgctgacctgtagaataagttccaaacctcttggcgtcacattcaaggccctgggagccacccactgcctcctttccagtgtctctccttgggcgccttcactgttccagtccctccaacatattccaccatgccacagccacgccagctgctcttccgctgctcacactggtcctgttaactcatgcatctttccctccttcactgtctaccactgtcctctcctgcctggccaggcaggcagagtgagggctccttcctctgggatatccaagcccaggaagggtcctctcctgtacctcttcccatactgcatcctaactattgccacagccgccctcttcattggactgtgagctcccggtggcaggctttgtgtttgattaatttctgtatttccagagcccagctcagagtctgatccagcgtaaatatttattactacgattaagggccgggtgtggtggctcatgcctgtaatcccagcactttgggaggctgagacgggaggattgcttgagctcaggagttcaagaccagcctgggcaacatggtgagaccccgtctctacaaaaaatacaaaaattagccaggcatgctagtttgtgcctgtagtcccagctactcggggcactgaggtgggaggattgcttgagcccaggaggctgaggttgcagtgagtcatgattgcgacactgcacttcagcctgggcaacagagtgagaccctttctcaaaaattaaaaaaacagaggcctgtggtggggtggggggagaggggagggatagcattaggagatatacctaatgtaaatgacgagttaatgggtgtagctcaccaacatggcacatgtatacatatgtaacaaacctgcatgttgtgcacatgtaccctagaacttaaagtaaaattaaacaaacaaaaaaaaagggctgggagcagtggctcacgcctataatcccagcactttgggaggccaaggcgggcggatcgcttgaggtcaggagttcaagaccagcctggccagcatggcaaaaccccgtctctactaaaaatagaaaaattagccaggggtggtggtgggcgcctgtaatcccagctacacaggacgctgaggcacgagaatcacttgaacccagcaggcagaggttgcagtgagccaagattgcaccactgcaccccagcctgggtgacagagtgagactctgtctcaaaataataataataataataataataataataataataaccaaaaaaaattcttaccgttcttaaatattgactgttcctggtatatattaataggaacagtgtcacatcttctgtgtgcctgagaaagggctggacaccttgcctgtgtcatctcatctatttttattttttattttattttatttttttgtacactatttatcttagatatgtcatctcatttagtctgtagccaccagaaggatgatcagtagtgtccccattttgcacctaaggacactgatgcacagagaggctgagtgattgcccaggtcaatttctgcaaagcctgccatggcaactgctatggtagattgtctcacagaaagagtcagtgcatcaagagtcccctgctcgcccacaggcagggctggctcattgaccctccctctctcccaccctccctctcccccaccagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggttgggattgggatggcttccctgctgccctgggatttggaagaatgttgaggactgtggatgtcccattccctggtcatggggtgcggggcacccagcagtgattctaggaatagcacagagttaccaggtgttgttgagagcttggctctgtgctccgtagggtcctggcttgccccttattagtgggtgaccaagttcgcttagctccaaaattaacttaagttatgtagagggaagggaacttacacttaagggtaacaaaaaaaattcttactgttattaaatattgacttctggtgtacattacctcttggtaatatattgttagctcttggcttggtgcagtggctcacgcctataatcccaacactttgggaggccaaggcaggtggggcacttgaggtcaggagttcaagaccagcctggccaacatggcgaaaccctgtctctactcaaaatataaaaattagcctgcggcgcacacctgtaatcccagctactcaggaggttgaggcaggaggatcacttgaacccaggaggcagaggctgctgtgagctaagatcgtgccactgcactccaacctgggcaatagagtgagacttcgtcttaaaaaaaggatgcctctgatgctttaggcactgtgcttagtgcttgacagagtcagcctccccagtccattccctgtaagggaggtctgttagatccatttatcagatgagtacgataaggctcagggaaattcagtacttcccctgtttacgcacatagaagggagtggagttgagattttaaaatctaagcagaggactaactcatgcttataatcccagcactttgggaagccaaggcaggaggatcgcttgaggccaggagcttgaagctgcagtgagctatgatctcactactgcactccagcctgggcaccatagcaagatcccatctctaaaaactttttttgttaaattaactgggcatggtggtgcacacctgtagtcccagctactcaagaggctgacatgggaggatcacttgagccagaaatcaagcttgcagcaagctatgatcacatcactgcactccagcttggatgacagagtaagaccctgtctctttaaaaaaaaaaaaagtctaggcagactggttttatttatttattcatttattattgagacagggtcttgctctgtcacccaggctggagtacagtggcgcaatctcgactcactgccacctctgcctcctgggttcaagtgattctcctgcctcagcctcccgaatagctggaattacaggcacctgccaccatgcccagctaatttttttgtagttttagtagcgacggggtttcaccgtgttggccaggctggtcttgaactcctgacctctagtgatcggcccgcctccgcctcccaaaatgctgggattgcaggtgtgaaccaccgcgcccggcccaggctggttcgaaagtgttcttaatctctatgatatgtcacctcctttattattgctgttattaacaattataggaaaaaaaattagccaggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaaaaaaacaattataggaagcacatatttattatcaaacgcttcatctttcaaagcaaatttttattgttacttcatttgatcctatagcagacctgtgagatagatacttcaattaatattcttatttcatgcataaggaaacaggctcagggatggtgtcagttacctagttagaaagaaagatgaagacaggagcccatgaaacaaagaccttcaagccacatcttcccagcatccgggctgtcccgtgcatccggagtgttccccagggagcacctccgcaggttggtaaaggagagggccccgctcaatgaaagctgcccaacacagtgaagggagcatcagggctgggcgtggtggcccacgcctgtaatcctagccctttgggaggttgaggtgggcagatcacttgaggtcaggagtttgagaccagcctggctaacttggggaaaccccgtctctactaaaaaagtacagaaattagccaggcatggtggtgggcacctgtaatcccagctactcggaagactgaggcaggaaagtctcttgaacccaggagacggaggttgcagtgagccgagatcataccactgcactccatcctgggcaacagagcaagattccgtctcaaaaaagaaaaagagatttggaggattaaacagcttgcttgagaagatttcaagtgattcaagaagtggaaagggcatgaactagaagtagggagtgatgtggacagggatgactggcagatttctgccttgaacaacttgtggccagcagggccgttttcactgactgagtgtttgtggcaggaagaacagcgtccctgagtggtttgttttgggtatctacggttagaggagcctgtgggacatataagcggagataggtagaggctgttggttgctcaacatcagcaggatccgaagcttgaaaagaggtgggaaaatatggtcagctctatggtggtgataggagtgtgggagaacaaatcgattaggatgagatttggctgcatgtgattgaaaacccaaattaacagtggcttaaatgtgacataattttttttttttttttttgagatggagtcttgctccgtccccaggctggagtgcagtggtgccatctcagctcattgcaacctctgcacccaggtcctggttcaagcaattctccttcctcaacctcccaagtagctgggattacaggcgcgcaccaccacatccagctaatttttgtatttttagtagagatggggtttcaccacgttggccagtctggtcttgaactcctgaccttgtgatcggcccaccttggcctcccaaagtgctgagattacaggcgtgagccactgcacttggccagaaatttttttttttttttttttttttttggagacaagagtctcagtctgtcgcccaggctggagtgcagtgacgtgatcttggctcactgcaacctccacctcccgggttcaagtgattctcgtgactcagcctccctgagtagctgggattacaggtgcccactgccacgcccggctaattttgtatttttagtacacacagggttttgccgtgttggccaggctggtttcaaactcctgccctcaggtgatctgcccgccttggcctcccaaagtgctgggattacaggcatgaaccactgcacccagcccagaaatttgtttttttcaagttcagaggtagacatttcaggactggtatagcagctcaacaagttgtcaagcaggcttctcctatattgctgttttgccataggtagcacattgcctcatggtccaagatgactgcttgagtgccagccatcatgtccacattccagccagcaaaaaggaggagaaggaggaataaagaaaggcacaccctcttcctttgaagagttgtcctaggccaggcacggtggctcatgcctgtaatcctagcactttgggaggccgaggcgagcagatcatttgaggcctagatgggtggtctcaggagttcgagaccagcctggccaacatggttaaacccccttctactaaaaatacaaaaaaattagctgggcgtggtggcacgcatctgtaattctagctacttgggaggctgaggcaggagaatcgcttgaacctaggaggcagaggtagcagtgagcagagatagtgccattgcactccagcttgggcaacaagaatgaaacttcttattaaaagaaaaaaagttgtcctgggccaggcacggtggctcacacctgtaatcccagcactttgggaggctgaggtgggtggtttcaggagttcgagacaagcctggccaaaatagtgaaaccctgtctctactaaaaatacaaaaattagccgggcgtggtggcgagcgcctgtaatcccagctactcatgaggctgaggcaggagaatcgcttgaacccaggaggcggaggttgcagtgagccgagattatgccactccactctagtcggggcaacagagtgagactccatctcaaaaaaatgtaataataatacaaataaaataaagagttgtcctggaaggtccccttggcttatctgtttccatctcagtagctggaacttagccagatgatctgtttagttgcaaggaagctgagaaatgtggatggtattttaggatttaggccacatgcccaactaacaatgtgaagtgtgctggccattggtgtaatcccaacccagatgctgggaatcacacttgtaatgccagcaccttgggaggctgaggtgggaggatcacttgaggcctggagttcaaaaccagtctgggcaacatagcaagatcctgtctccacaaaaaaatacaaaaattagctcattggtgcacatgcctgtagtcccagctaatcaggaggctgaggcaggagaatggcttgaacccaggaggcggaggtagcagcgagccgagattgtgccactgcactccagcctgggtgatagagcaagactccatctcaaaaaaaaaaaggtaaagttctatgacgaaagaaaaaaatggatgttggagaaggaagacatggtgagtgacgggaccacaggaagaagtcgtgaccttcatccttgcccttatgtcctggggcaagtcgtggaagcttctagagcctctgtgttcttatctctggaatgagggtggacagcaccttctagggaggattaggagagctgatgtgcttggagaggaagctctgaacagacccggggcttcagcactttggagggggaactattgctgccacaccccgctccctccaggcccacgaggactcggagaagctgcgggagatcgtactgcccatggaaaaggagatcgaggagctgaaggcgaagctgctgagggccgaggagctgattcaggagatccaggtgagggcacggccagggggcgctggggaaggaggggtgccagaggaccctggccccccagcctcttccctgcccccttccctagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagaggtgagtgttgtgggcagggtggcggggtgtaccatccccctctctgctggatgcttcccccgcaccacctgtgttcagacccagaactagagccggagcttccacagggagaagagaggcccccctcctggtgaaggcaggcagatgtaaacatgcataggggccaggtgcggtggctcacacctgccatcccagccactcggaagctgggtgggaagattgtggctaggagttcaaggccagtctgggcaacatagtaagaccctgtctctttacaaaagttaaaaaaaaaaaaaaaagccaagtatacacttgtagtcccagctacttgggaggctgaggcaggaggatctcttgagcccaggagattgaggttgcagtgaaccgagatcgtgccacccactccagcctgggtcacagagtgagaacctgtctcaaaaaaaaaaaaaaaaaaaaagaggccgggtgcggtggttcatgcctgtaatcccagcactttgggaggccgaggtgggtggatcacctgaggtcaggagtttgagaccagcctggacaacatggtgaaaccccatctaaaaacacaaaaattagctgggcgtggtggcgcatgcccgtaatcccagctactcaggaggctgagggaggagaatcgcttgaactggggaggcggaggttgcagtgagccaagatcaaaccactgcactccatcctgggcaacaagagtgaaactctgtctcaaaataataataacaataatgtgatacaaaaaatgaattgtatatttaacatgggtaaattatgtggtaaagaaattataactcaataaagatgctttaaaaaaaaatgcacatggatgcatggggaagacattgtcaccagggagatgcccagagaaaaacaaaactgggcttataggatagagactggcagtgagggagactgacccgggttcaggctggaactgagacccagatggcgtgaggaagtactcttaaagaccggggcaggccgggcgcggtggctcatgcctgtaatcccagcactttgggaggccgagatgggcagatcacctgaggttgagagttcaagaccagcctgaccaacatggagacaagcatggtggcgcatgcctgtaatcccagctacttgggaggctgaggcaggagaatcgcttgaacccaggaggcagaagttgtggtaagccgagatcgcgccattgcactccagcccgggcaagaagagaagcagagagaaactgtgtctcaaaaaaaaagagaaaaaaaaaccggggcacaaggaactgtgagttcgaaggccctgaggatggagagaccacagtgtgtctgaggaacaggaaggccaccggggaggagagaagaggagaccagaaagaaaggcagggccacatgagtccgacctcgggggcctgttgtgcattgtgcgtcttaggagacgtgggaagcacctgcagggttaagcaacggagaagcctcccggctccaggctttcaaaagctcacttggggccaggtgcagtggctcacgcgtgtaatctcagcactttgggacactgaagcgggcagaatgctggagcccaggagtttgagaccagcctgggcaacatgatgaaaccctgtcctacaaaaaaacacaaaaaagtagctgggcacagtggcacatgcctatgatccaggctacttcgagaggttgagatgagaggattgcttgagcccaggaggtcgatgctgcagtgagctgagatcgtgcgccactgcactccagcctgggtcacagagtgagaccccatctcaaaaaaaaaaaaaaaaaaaagaaagaaagaaagcttacttggggctgtgttggggtaggggacacaggagaagctgagaggctgggactgtggtgtacaggaaggtggtaccttggaccaggggatggccgcagagacaggaagaaatgggtggatgtggaatccactttttttttttttgagatggagtctcgctgtgtcacccaggctggagtgcagtggtgtggttctcggctcactgctagctccacctaccgggttcatgccatactcctgcctcagccttccgagtagctgggactacaggcgcctgccaccacacctggctaattttttgtgtttatagtagagacggggtttcaccatgttagccaggatggtctcgatctcctgacctcgtgatccgcccacctcggcctcccaaagtgctgggattacaggtgcgagccaccatgcccggctggaatccactttttttaagatggagtcctgtcctgtcacccaggctggagtgcagtggcctgatcttggctcactgcaacctctgtctttcaggttcaagcgattctcctgcctcagcctccccagtagctgggattacaggggcccgccaccacgtccaactactttttttgtatttttagtagagacaaggtttcaccatattggtcaggctggtcttgaactcctgaccacccacctcagcctcccaaagtggtgggattataggcatgagccaccatgcctggccctgttttttttttttttttctcttttttgagacggaatctcactcacggcaacctctgctcactgctcactgcaacctctgcttcctgggtttaagtgaatctcctgcctcagtttcccgagtagctgagattacaggtgtcccgccaccacgcccggctaattttttgtatttttagtagagacagggttttaccatgttggccaggctggttttgaactcctgacctcaaatgatccacccgcctcggccttccaaagtgctgggattacaggcgtgaccccactccacccagtcctgtggaatccactttggaggtggacctggcagggcctgctgatgggtggggagtgaagggaagagaatggatggctgggcctgtaatttgacggactgtgtggatgagggcacctccctgcagaggtgggccacgagaagtgtggtgaggggggccaagttcctgggagatgcaggctgaaggcagggtctgtggcagggccgacagctgcagaaggacctggagagcgtcagtcgcgagcgggacgagctccaagagggcctgagacggagcaatgaggactgtgccaagcaggtgggtccctgccgctgctgcagccccagccggcctctggctacctgccgccccctgacatgcccttgccctcactttcgccctccctccaacccagatgcaggtgctcctggcccaggtccagaactcagagcagctgctgcggaccctgcaagggaccgtgagccaggcccaggagcgggtgcagctgcagatggtgagtacctgggggccctagggcaggagggcgaggagtccagcaggaatcagttgcacgtggtggaagggggcacgtgggaagtcaaggaacctgtcctgtccccagctgctcaggccacaccctggaaccggtgccaggtaggtaagagggttttggggcagctggtgccgtggccagaacagggcccctgcagccacacagagctgtttgatcttgagctaatcccagactcccagcctctgcctcaccatctataaaactgacataatgggccctagtttgcagagtcatgaggattaaaatcaaatctgactgggcgaggtgactcatacctgtaatcctagcactttgggaggcctaggcggttggatcacctgaggtcaggagttcgagcctagccaacacagggaaaccccatctctactaagaatacaaaaattagccgggcatggtggtgggcgcctataatcccagctacttggctgggcaggataatcgcttgaacccaggggacagaggttgtagtgagccgagatcacgccattgcacttcagcctgggtgaaagcaaaactgtctcaaagaaaaaaaaaaaaaaaaagcaaatcagatactgacaaagactggggaggagacatacgtgattgaacagggccaggtgtagggcaggagggtaggagggcagtaggcggcctggaaccagaggcccctgcaaggggctcctgcctctgggctttgctgactgtggccacctaggaacacaggttccctgctgccagattttctgatttttcaagagaaaccaaaaatatgaatatttgtgtattgtctcctatttttttttttttttttttttttgagacggagtctcgctctttcacccaggctggagtgcagtggcacgatctcggctcactgcaagctctgcctcccagattcacgccattctcctgcctcagcctcccgagtagctgagactacaggtgcctgccaccacgcccggttaatatttttttttgtatttttagtagagacggggtttcaccgtgttagccaggatggtctcgatctcctgacctcgtgatccacccgtctcggcctcccaaagtgctgggattacaggcgtaagccactgagcccggcctcctgtttttttttttttaagaaatggtgtgttgctctgtcgctcaggctggccaggctggagtgcagtggtgcaatcagagctcactgaagcctcaactttctgggctcaagcaatcctgcagcctcaccctcctgagtagctgggactacaggctcacaccaccatgcccagctaatttgtaaatttttttgtagagtcggggtctcactatgttgcccaggctggtctcaaactcctggcctcaagtgaccctcccaccttggcctcccccatagccagggttataggtgtgtggcaccacgcctggcttgtctcttaatttttagaattggcaactactttaaggttttaaaaatatatatgggccgggcacggtggctcacacctgtaatcccagcactttgggaggccaagacaggtggatcatctgaggtcaagagtttgagaccaacctgaccaacatggtgaaaccccgtctctactaaaagtacaaatattagccaggcgtgatggtgggcgcctgtaattccagctacttgggaggctgaggcaggagaatcgcttgaacccgggaggcggaggttgcagtgagccgagatcactctattgcactccagcctgagtgacagagggagactctgtctcaaaaaaatatatattttttaaaatttaaatttatatatatttaaatatttgtgtgtgtgtgtgtgtatgtgtatatatatatatatatatatatagaccaagtaaaatatctggcttgggccctggcagcagcctgtaatctgcgtgttagcagggacagaggtgtctgaagagcttggtagcaaaaagtgctccttccttgcttaggaacagagagggtatgggctctcttgctgtcagtctgggaggagggttcaaggaggtttggcctcctagggactggagacgccctgtcctcttcattgccttatactaactgtctgtccataggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagtaagctgagtgtgggcactgagagcctggagccaccgtgagggccccttcttcccaggcagggcagagcgttggtcacgaccagccagggtgctgtgtatttgcttggctaactcatttgccttctctaaggctcagtttcctcatctgagaaatggaaccatacatgctttccagcattggcatcaaaagaaaatgaattaacagaatgcttggcaggaaggaagcagtcatttggttggtttgctatttttaagtgacacgcgagccacaagattgaatttatcataatctttggtttatagcaagctgccatcatggatctatgcctagcctttgtcaactttttcttaataatatggcttattagccaggcgcgatggctcacacctgtaatcctagcactttgagaagctgaggcgggcggatcacttgaggtcaggaatttgagaccagcctggccaacggtaaaaccctgtctctactaaaaatacaaaaaaattagtcagggctaggcgcggtggctcacgcctgtaatcccagcactttgggaggccaaggtgggtggatcacctgaggtcaggagtttgagaccagcctgcccaacatggcaaaaccccatctctactaaaaatacaaaaattagcctggtgtggtggcgggcacctgtaatcccagctactcggtaggctgaggctggagaatcgattgaacccaggaggcggaggttgcagtgagccgaaatcgcgccattgcactccagcctgggtaacgagtgaaactctgtctcaaaagaaaaagaacattagttgggtgtggtggctcgtgcctgtaatcccagctacttgggaggctaaggcagaagaatcacttggcctgggagccagaagttgcagtgagccaagatcgcgccactgcactctagccttggcgagagagcaaggctccatctcaaaataataataataatatggcttattaataaattgattagaaatagatcacttggtggctgggcacagtggctcacgcctgtaatcacagcagtttagaaggctgaggcaggaggatcatttgagcccaggagttcaagaccagcctgggcaacaaagcaagaccctgtctctacaaaaaataaaaataaaaatattagctgggcttggtggcttgcgcctatagtcccagctacttaggagcctgaggcaggaggatcactcaagtccaggagttcaagatcagcctgggcaacatagttgagaccctgtctctacaaaaaatacaaaaattagccaggtgtggtggcctccacctgcagtcccagcaactcaagtgtctgaggtgggacgcttgagcctgggaggttgaggctacagtgagctgtgatcatgccactacactccatcctgggccacagagtgagaccctgtctcaaaaaaaaaaaaaaaacaaaggcaaaaaacaaaaaaaaagatccatggggcaccttccccaccctgagatctgtccacttccgggcacctcctccccattccttggctctgctttgcccttgcggtcttcggtgttttcattacatgtacagtgcgatgcttaactttcattgttcttgagctttacaaaagggtttattttattttatttttattttttgagacagagtctcgctctgtcgccccagctggagtgcagtggcaccatctcgattcactgtaacctccacctccttgggtcaagcaattctcctgcctcagcctcctgagtagctgggattacaggcgccggccaccagctggctaatttgttgttgttgttgttgttgtttgtttttgtttttgtttctgtttgagatggagtcttgttctgtcgcccaggctagagtgcagtggcgcgatctcggctcactgcaacctctgcctcctaggttcaagtgattcttctgcctcagcctccggagtagctgggactacaggcgtgcaccaccacgcctggctattttctgtatttttagtagaaacggagtttcaccatattggccaggctggtctcgaactcctgacctcacgtgatcctcccacctcagcctcccaaagtactgagattgcaggtgtgagccaccgcgcccggcaaggggctcttgctgtaggtaatctgctgaactttatggttgggactcttcctgagcgctctccacggtgtggggcatggtcgtgtgtcctgagcttcctctcctgggccggagcgcacctgtcctcctcccagatgatgggcattttgggctcttccccactttagccctttgcttccatcctcccttccttccccgttcctcccgacaatccccgtctggctggtggcccctgccctcctgccctcctgccccagcccagcaggtgactcctccgtcccttccaggagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacaggtgaggggaggggcacaagcccccagccccgggcccagggcccctgtcggccttgcagggagccaccggggcccaggcgtgggcagcagcggggaggggagagaggctggccttgacctctctttctttccttcccacagaggtgctggagggtgagtgtgtgctggaggtgatcttggggatcgcccaccctggctgggctaggtggggaaagggagagggcatggccctgacgtctccccctgccctgacttcccagcctccctgtgcagcctgaggacagagatggagcgggtgcagcaggaacagagcaaggtgagggggagggcagggggactgggaggagagggacccagctgtggaaaagaccctcccccacccctcccgccctctgtgtctccctcaggccaggtggaggaagccctggggcaacggctggccatgcaccctcccatctggtccaggctgagccaggcccagctcagtgtggtgtctgtccccgcaggcccagctcccagacctcctctcagaacagagggccaaggtgctgcggctgcaggcagagctggagaccagtgagcaggtgcagagggatttcgtgcgactgtcccaggccctgcaggtatggcctgtcccagccccgccaggctggctggctccactccgggtgacctctcctgggtcttgcaaggacagttccctggttaggggagtcctttcttcctcctggggctggcatggtcctgtcctgagctgttactcaaaaaaccctgaaactctcatgtgagccttggtcagtcacctgaagccctcagtacagggcatggtggacgctcagggcatttgtggcatcagccccctagaggtggcccctgggtccactggtaccaggccccgcccttgggggctggcaggtggggtaggggctgcgtttccccacaagtgcactctgctcccctcgtccgatccggcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgc

SEQ ID NO: 38825 - DNA, 12548 bp, Homo sapiens; identical to SEQ ID NO: 36459

SEQ ID NO: 38826 - DNA, 2029 bp, Homo sapiens; identical to SEQ ID NO: 38429

SEQ ID NO: 38827 - DNA, 19 bp, Artificial Sequence
  Description of Artificial Sequence: Synthetic primer
gaaggtgaaggtcggagtc

SEQ ID NO: 38828 - DNA, 18 bp, Artificial Sequence
  Description of Artificial Sequence: Synthetic primer
tggtgctgcacccctcat

SEQ ID NO: 38829 - DNA, 19 bp, Artificial Sequence
  Description of Artificial Sequence: Synthetic primer
gaagatgccgaccgcaaat

SEQ ID NO: 38830 - DNA, 22 bp, Artificial Sequence
  Description of Artificial Sequence: Synthetic primer
tggtcatcctcccttgagaaga

SEQ ID NO: 38831 - DNA, 19 bp, Artificial Sequence
  Description of Artificial Sequence: Synthetic primer
ggcttccctggtcctcttg

SEQ ID NO: 38832 - DNA, 23 bp, Artificial Sequence
  Description of Artificial Sequence: Synthetic primer
tttgtgtgtgaggacagcatctc

SEQ ID NO: 38833 - DNA, 22 bp, Artificial Sequence
  Description of Artificial Sequence: Synthetic primer
gcgctgagcagaatgagtagct

SEQ ID NO: 38834 - DNA, 21 bp, Artificial Sequence
  Description of Artificial Sequence: Synthetic primer
cctggaagctctgggctacac

SEQ ID NO: 38835 - DNA, 18 bp, Artificial Sequence
  Description of Artificial Sequence: Synthetic primer
gcgacctgggctccattt

SEQ ID NO: 38836 - DNA, 19 bp, Artificial Sequence
  Description of Artificial Sequence: Synthetic primer
cgtgcccctcatccagtct

SEQ ID NO: 38837 - DNA, 21 bp, Artificial Sequence
  Description of Artificial Sequence: Synthetic primer
tttctcagggcagatgatgct

SEQ ID NO: 38838 - DNA, 20 bp, Artificial Sequence
  Description of Artificial Sequence: Synthetic primer
ctccagtccctgccttcaga

SEQ ID NO: 38839 - DNA, 22 bp, Artificial Sequence
  Description of Artificial Sequence: Synthetic primer
cacagagatgaaccggatgatc

SEQ ID NO: 38840 - DNA, 22 bp, Artificial Sequence
  Description of Artificial Sequence: Synthetic primer
gggcttcacagaggataccatt

SEQ ID NO: 38841 - DNA, 22 bp, Artificial Sequence
  Description of Artificial Sequence: Synthetic primer
cctctgcaaggctttcaatagc

SEQ ID NO: 38842 - DNA, 18 bp, Artificial Sequence
  Description of Artificial Sequence: Synthetic primer
cgagagccgagccagaca

SEQ ID NO: 38843 - DNA, 22 bp, Artificial Sequence
  Description of Artificial Sequence: Synthetic primer
ccagtcctacacctgcgagatt

SEQ ID NO: 38844 - DNA, 19 bp, Artificial Sequence
  Description of Artificial Sequence: Synthetic primer
ctctccgacctgccacaga

SEQ ID NO: 38845 - DNA, 21 bp, Artificial Sequence
  Description of Artificial Sequence: Synthetic primer
caggcttggtgtctgcttacg

SEQ ID NO: 38846 - DNA, 24 bp, Artificial Sequence
  Description of Artificial Sequence: Synthetic primer
ttaaggaggctttcaacatgattg

SEQ ID NO: 38847 - DNA, 19 bp, Artificial Sequence
  Description of Artificial Sequence: Synthetic primer
acgggagagctggaaaagc

SEQ ID NO: 38848 - DNA, 21 bp, Artificial Sequence
  Description of Artificial Sequence: Synthetic primer
ccaaaggacagcagtgatgga

SEQ ID NO: 38849 - DNA, 20 bp, Artificial Sequence
  Description of Artificial Sequence: Synthetic primer
ctgaaccatccaggccaaat

SEQ ID NO: 38850 - DNA, 20 bp, Artificial Sequence
  Description of Artificial Sequence: Synthetic primer
tttaggaccgtgggtcatgc

SEQ ID NO: 38851 - DNA, 23 bp, Artificial Sequence
  Description of Artificial Sequence: Synthetic primer
gtgaaacagagtgattggttgca

SEQ ID NO: 38852 - DNA, 25 bp, Artificial Sequence
  Description of Artificial Sequence: Synthetic primer
ctctcctcttatctcctatgctgga

SEQ ID NO: 38853 - DNA, 20 bp, Artificial Sequence
  Description of Artificial Sequence: Synthetic primer
gagacagctgaggtcaccgc

SEQ ID NO: 38854 - DNA, 23 bp, Artificial Sequence
  Description of Artificial Sequence: Synthetic primer
caccataaaagagctggaatcga

SEQ ID NO: 38855 - DNA, 32 bp, Artificial Sequence
  Description of Artificial Sequence: Synthetic primer
gtagtggaatatgtcttctgtataactaggct

SEQ ID NO: 38856 - DNA, 22 bp, Artificial Sequence
  Description of Artificial Sequence: Synthetic primer
tctgtttgctgttcatgaccct

SEQ ID NO: 38857 - DNA, 19 bp, Artificial Sequence
  Description of Artificial Sequence: Synthetic primer
catgcgagggcttcatagc

SEQ ID NO: 38858 - DNA, 20 bp, Artificial Sequence
  Description of Artificial Sequence: Synthetic primer
gaagatggtgatgggatttc

SEQ ID NO: 38859 - DNA, 20 bp, Artificial Sequence
  Description of Artificial Sequence: Synthetic primer
ccagggttgggaatgcttct

SEQ ID NO: 38860 - DNA, 20 bp, Artificial Sequence
  Description of Artificial Sequence: Synthetic primer
cgttccaggtcgctctcaat

SEQ ID NO: 38861 - DNA, 21 bp, Artificial Sequence
  Description of Artificial Sequence: Synthetic primer
cgttcatttccgatggtgatc

SEQ ID NO: 38862 - DNA, 20 bp, Artificial Sequence
  Description of Artificial Sequence: Synthetic primer
gggaccacgttcaccacttg

SEQ ID NO: 38863 - DNA, 18 bp, Artificial Sequence
  Description of Artificial Sequence: Synthetic primer
gccccaactcacaatgcc

SEQ ID NO: 38864 - DNA, 23 bp, Artificial Sequence
  Description of Artificial Sequence: Synthetic primer
acctcacaaggacagcacagttt

SEQ ID NO: 38865 - DNA, 24 bp, Artificial Sequence
  Description of Artificial Sequence: Synthetic primer
ttccaaactttcacaacacactga

SEQ ID NO: 38866 - DNA, 19 bp, Artificial Sequence
  Description of Artificial Sequence: Synthetic primer
agccacttccgcgttcaag

SEQ ID NO: 38867 - DNA, 18 bp, Artificial Sequence
  Description of Artificial Sequence: Synthetic primer
gccagggttgggaatgct

SEQ ID NO: 38868 - DNA, 21 bp, Artificial Sequence
  Description of Artificial Sequence: Synthetic primer
aagcccattttcctcaaagct

SEQ ID NO: 38869 - DNA, 21 bp, Artificial Sequence
  Description of Artificial Sequence: Synthetic primer
gcatgcaaagccctgaaataa

SEQ ID NO: 38870 - DNA, 20 bp, Artificial Sequence
  Description of Artificial Sequence: Synthetic primer
ttggcgcactgtttcttgac

SEQ ID NO: 38871 - DNA, 22 bp, Artificial Sequence
  Description of Artificial Sequence: Synthetic primer
agtcctattgttccgtcatgca

SEQ ID NO: 38872 - DNA, 22 bp, Artificial Sequence
  Description of Artificial Sequence: Synthetic primer
cgatgctcagagctttctccat

SEQ ID NO: 38873 - DNA, 21 bp, Artificial Sequence
  Description of Artificial Sequence: Synthetic primer
ctctgaggccatcagggactt

SEQ ID NO: 38874 - DNA, 19 bp, Artificial Sequence
  Description of Artificial Sequence: Synthetic primer
cctccaattcccgcatctg

SEQ ID NO: 38875 - DNA, 20 bp, Artificial Sequence
  Description of Artificial Sequence: Synthetic primer
aacctagatgggcgcgatct

SEQ ID NO: 38876 - DNA, 18 bp, Artificial Sequence
  Description of Artificial Sequence: Synthetic primer
tcccgcattgctcgtgtt

SEQ ID NO: 38877 - DNA, 20 bp, Artificial Sequence
  Description of Artificial Sequence: Synthetic primer
gtcgtgcaggtcctccttgt

SEQ ID NO: 38878 - DNA, 18 bp, Artificial Sequence
  Description of Artificial Sequence: Synthetic primer
ttttggcgttgccgaaag

SEQ ID NO: 38879 - DNA, 21 bp, Artificial Sequence
  Description of Artificial Sequence: Synthetic primer
ccggattggaaaatgaagtca

SEQ ID NO: 38880 - DNA, 18 bp, Artificial Sequence
  Description of Artificial Sequence: Synthetic primer
gccgtgtggcaatccaat

SEQ ID NO: 38881 - DNA, 21 bp, Artificial Sequence
  Description of Artificial Sequence: Synthetic primer
atagctgagtgcgtggagagg

SEQ ID NO: 38882 - DNA, 25 bp, Artificial Sequence
  Description of Artificial Sequence: Synthetic primer
gaatgtgcttagagggagatcatga

SEQ ID NO: 38883 - DNA, 22 bp, Artificial Sequence
  Description of Artificial Sequence: Synthetic primer
cgatgattagaggtgcatggaa

SEQ ID NO: 38884 - DNA, 21 bp, Artificial Sequence
  Description of Artificial Sequence: Synthetic primer
attgtgtcccaaatgccactg

SEQ ID NO: 38885 - DNA, 24 bp, Artificial Sequence
  Description of Artificial Sequence: Synthetic primer
gtgcaagatgaatcctcaggattt

SEQ ID NO: 38886 - DNA, 24 bp, Artificial Sequence
  Description of Artificial Sequence: Synthetic primer
catccccgagaacacttaaaattt

SEQ ID NO: 38887 - DNA, 21 bp, Artificial Sequence
  Description of Artificial Sequence: Synthetic primer
aagaacccctttgcaggtctc

SEQ ID NO: 38888 - DNA, 19 bp, Artificial Sequence
  Description of Artificial Sequence: Synthetic primer
gatgcccctcgagatctgg
